US012577562B2

(12) United States Patent
Praveen et al.

(10) Patent No.: US 12,577,562 B2
(45) Date of Patent: Mar. 17, 2026

(54) TREATMENT OF GLAUCOMA WITH RHO GUANINE NUCLEOTIDE EXCHANGE FACTOR 12 (ARHGEF12) INHIBITORS

(71) Applicant: Regeneron Pharmaceuticals, Inc., Tarrytown, NY (US)

(72) Inventors: Kavita Praveen, Tarrytown, NY (US); Giovanni Coppola, Tarrytown, NY (US); Manuel Allen Revez Ferreira, Tarrytown, NY (US); Lauren Gurski, Tarrytown, NY (US); Aris Baras, Tarrytown, NY (US); Claudia Schurmann, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 456 days.

(21) Appl. No.: 17/936,244

(22) Filed: Sep. 28, 2022

(65) Prior Publication Data

US 2023/0099109 A1      Mar. 30, 2023

Related U.S. Application Data

(60) Provisional application No. 63/250,492, filed on Sep. 30, 2021.

(51) Int. Cl.
| | |
|---|---|
| *C12N 15/113* | (2010.01) |
| *A61P 27/06* | (2006.01) |
| *C08G 69/10* | (2006.01) |

(52) U.S. Cl.
CPC ........... *C12N 15/113* (2013.01); *A61P 27/06* (2018.01); *C08G 69/10* (2013.01); *C12N 2310/11* (2013.01); *C12N 2310/14* (2013.01); *C12N 2310/531* (2013.01)

(58) Field of Classification Search
CPC .............. C12N 15/113; C12N 2310/11; C12N 2310/14; C12N 2310/531; C12N 2310/20; C12N 2320/30; C12N 2320/34; A61P 27/06; C08G 69/10; C12Q 2600/156; C12Q 1/6883; A61K 31/7088
See application file for complete search history.

(56) References Cited

FOREIGN PATENT DOCUMENTS

| | | | |
|---|---|---|---|
| EP | 1568382 | 8/2005 | |
| WO | WO-2006104751 A2 * | 10/2006 | ........... A61K 31/165 |
| WO | 2007076367 | 7/2007 | |
| WO | 2012146936 | 11/2012 | |
| WO | 2020081562 | 4/2020 | |
| WO | WO-2020154268 A2 * | 7/2020 | ......... A61K 31/7105 |

OTHER PUBLICATIONS

Human Molecular Genetics, vol. 24, Issue 9, May 1, 2015, pp. 2689-2699 (Year: 2015).*
Agnifili et al. Prog. Brain Res. 221, pp. 1-32. (Year: 2015).*
Chai et al. (Invest Ophthalmol Vis Sci.; 61(10):37, pp. 1-8 (Year: 2020).*
Springelkamp et al., "ARHGEF12 influences the risk of glaucoma by increasing intraocular pressure", Human Molecular Genetics, 2015, 24(9), pp. 2689-2699.
Springelkamp et al., "New insights into the genetics of primary open-angle glaucoma based on meta-analysis of intraocular pressure and optic disc characteristics", Human Molecular Genetics, 2017, 26(2), pp. 438-453.
Nagase et al., "Prediction of the coding sequences of unidentified human genes VII. The complete sequences of 100 new cDNA clones from brain which can code for large proteins in vitro", DNA Research, 1997, 4, pp. 141-150.
Anonymous, Database UniProt, "ARHGEF12—rs2305013, partial screenshot", 2023, pp. 1.

* cited by examiner

*Primary Examiner* — Brian Whiteman
(74) *Attorney, Agent, or Firm* — Armstrong Teasdale LLP

(57) ABSTRACT

The present disclosure provides methods of treating subjects having glaucoma or elevated intraocular pressure (IOP), methods of identifying subjects having an increased risk of developing glaucoma or developing elevated IOP, methods of detecting human Rho Guanine Nucleotide Exchange Factor 12 (ARHGEF12) variant nucleic acid molecules and variant polypeptides, and ARHGEF12 variant nucleic acid molecules and variant polypeptides.

8 Claims, 3 Drawing Sheets

Specification includes a Sequence Listing.

| Study | Cases | Controls | AAF | | OR (LCI \| UCI) | p-value |
|---|---|---|---|---|---|---|
| GHS | 7,163 \| 844 \| 25 | 103,109 \| 10,792 \| 270 | 0.0498 | | 1.18 (1.09 \| 1.27) | 2.7E-05 |
| UKB | 10,949 \| 1,382 \| 46 | 362,114 \| 37,901 \| 963 | 0.0500 | | 1.22 (1.15 \| 1.29) | 5.3E-12 |
| SINAI | 376 \| 32 \| 1 | 8,358 \| 799 \| 21 | 0.0450 | | 0.85 (0.60 \| 1.22) | 3.8E-01 |
| MALMO | 2,058 \| 324 \| 13 | 23,006 \| 2,962 \| 94 | 0.0614 | | 1.23 (1.09 \| 1.40) | 1.2E-03 |
| EstBB | 6,771 \| 831 \| 25 | 115,363 \| 12,379 \| 332 | 0.0741 | | 1.14 (1.07 \| 1.23) | 1.4E-04 |
| FinnGen | 3,085 \| 366 \| 10 | 83,802 \| 8,992 \| 241 | 0.0509 | | 1.11 (1.01 \| 1.21) | 2.4E-02 |
| Meta | 30,402 \| 3,779 \| 120 | 695,752 \| 73,825 \| 1,921 | 0.0507 | | 1.17 (1.14 \| 1.21) | 4.8E-21 |

OR (95% CI)

TREATMENT OF GLAUCOMA WITH RHO GUANINE NUCLEOTIDE EXCHANGE FACTOR 12 (ARHGEF12) INHIBITORS

REFERENCE TO SEQUENCE LISTING

This application includes a Sequence Listing submitted electronically as an XML file named 381203615SEQ, created on Sep. 23, 2022, with a size of 1,732,255 bytes. The Sequence Listing is incorporated herein by reference.

FIELD

The present disclosure relates generally to the treatment of subjects having glaucoma with Rho Guanine Nucleotide Exchange Factor 12 (ARHGEF12) inhibitors, methods of identifying subjects having an increased risk of developing glaucoma, methods of detecting ARHGEF12 variant nucleic acid molecules and variant polypeptides, and ARHGEF12 variant nucleic acid molecules and ARHGEF12 variant polypeptides.

BACKGROUND

Glaucoma is a collection of disorders that damage the optic nerve of the eye and can result in partial vision loss and blindness. Several types of glaucoma exist, the primary form being open-angle glaucoma, whereby fluid within the eye builds up and increases the pressure inside the eye to a level that may damage the optic nerve. In low-tension or normal-tension glaucoma, optic nerve damage and narrowed side vision occur in people with normal ocular pressure. In angle-closure glaucoma, the fluid at the front of the eye cannot drain properly, which may lead to a sudden increase in ocular pressure. In congenital glaucoma, children are born with a defect in the eye that slows the normal drainage of fluid. Glaucoma treatments include drug therapy, laser trabeculoplasty, and conventional surgery. While these treatments may save remaining vision, they do not improve sight already lost from glaucoma.

Rho Guanine Nucleotide Exchange Factor 12 (ARHGEF12) is a member of Rho GTPAses family of signaling proteins that play a fundamental role in numerous cellular processes that are initiated by extracellular stimuli working through G protein-coupled receptors. ARHGEF12 is activated by heteromeric G protein (via interaction with $G\alpha_{12/13}$ and $G\alpha_q$) and in turn binds to RhoA and facilitates the GDP/GTP exchange reaction. This interaction activates the ROCK pathway leading to cytoskeletal reorganization. ARHGEF12 can form a homodimer or a heterodimer with ARHGEF11, which can regulate the activity of ARHGEF12.

SUMMARY

The present disclosure provides methods of treating a subject having glaucoma, the methods comprising administering an ARHGEF12 inhibitor to the subject.

The present disclosure also provides methods of treating a subject having primary open-angle glaucoma (POAG), the methods comprising administering an ARHGEF12 inhibitor to the subject.

The present disclosure also provides methods of treating a subject having elevated intraocular pressure (IOP), the method comprising administering an ARHGEF12 inhibitor to the subject.

The present disclosure also provides methods of treating a subject with a therapeutic agent that treats or inhibits glaucoma or elevated IOP, wherein the subject is suffering from glaucoma or elevated IOP, the methods comprising the steps of: determining whether the subject has an ARHGEF12 predicted loss-of-function variant nucleic acid molecule encoding a human ARHGEF12 polypeptide or an ARHGEF12 predicted gain-of-function variant nucleic acid molecule encoding a human ARHGEF12 polypeptide by: obtaining or having obtained a biological sample from the subject; and performing or having performed a genotyping assay on the biological sample to determine if the subject has a genotype comprising the ARHGEF12 predicted loss-of-function variant nucleic acid molecule or ARHGEF12 predicted gain-of-function variant nucleic acid molecule; and when the subject is ARHGEF12 reference, then administering or continuing to administer to the subject the therapeutic agent that treats or inhibits glaucoma or elevated IOP in a standard dosage amount, and administering to the subject an ARHGEF12 inhibitor; and when the subject is heterozygous for an ARHGEF12 predicted loss-of-function variant, then administering or continuing to administer to the subject the therapeutic agent that treats or inhibits glaucoma or elevated IOP in an amount that is the same as or lower than a standard dosage amount, and administering to the subject an ARHGEF12 inhibitor; when the subject is heterozygous for an ARHGEF12 predicted gain-of-function variant, then administering or continuing to administer to the subject the therapeutic agent that treats or inhibits glaucoma or elevated IOP in a dosage amount that is the same as or greater than a standard dosage amount, and administering to the subject an ARHGEF12 inhibitor; wherein the presence of a genotype having the ARHGEF12 predicted loss-of-function variant nucleic acid molecule encoding the human ARHGEF12 polypeptide indicates the subject has a reduced risk of developing glaucoma or developing elevated IOP; and wherein the presence of a genotype having the ARHGEF12 predicted gain-of-function variant nucleic acid molecule encoding the human ARHGEF12 polypeptide indicates the subject has an increased risk of developing glaucoma or developing elevated IOP.

The present disclosure also provides methods of identifying a subject having an increased risk for developing glaucoma or developing elevated IOP, wherein the methods comprise: determining or having determined the presence or absence of an ARHGEF12 predicted gain-of-function variant nucleic acid molecule encoding a human ARHGEF12 polypeptide or an ARHGEF12 predicted loss-of-function variant nucleic acid molecule encoding a human ARHGEF12 polypeptide in a biological sample obtained from the subject; wherein: when the subject is ARHGEF12 reference, then the subject has an increased risk for developing glaucoma; and when the subject is heterozygous or homozygous for an ARHGEF12 predicted loss-of-function variant nucleic acid molecule, then the subject has a decreased risk for developing glaucoma or developing elevated IOP; and when the subject is heterozygous or homozygous for an ARHGEF12 predicted gain-of-function variant nucleic acid molecule, then the subject has an increased risk for developing glaucoma or developing elevated IOP.

The present disclosure also provides methods of detecting a human ARHGEF12 variant nucleic acid molecule in a subject comprising assaying a sample obtained from the subject to determine whether a nucleic acid molecule in the sample is: a genomic nucleic acid molecule comprising a nucleotide sequence comprising: a thymine at a position corresponding to position 141,048 according to SEQ ID NO:4, or the complement thereof; or an adenine at a position corresponding to position 73,039 according to SEQ ID NO:5, or the complement thereof; an mRNA molecule having a nucleotide sequence comprising a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; or a cDNA molecule produced from an mRNA molecule, wherein the cDNA molecule has a nucleotide sequence comprising a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof.

The present disclosure also provides methods of detecting the presence of a human ARHGEF12 Glu1156STOP variant polypeptide, comprising performing an assay on a sample obtained from a subject to determine whether an ARHGEF12 protein in the sample terminates at a position corresponding to position 1,155 according to SEQ ID NO:81.

The present disclosure also provides isolated alteration-specific probes or alteration-specific primers comprising at least about 15 nucleotides, wherein the alteration-specific probe or alteration-specific primer comprises a nucleotide sequence which is complementary to a portion of a nucleotide sequence encoding a human ARHGEF12 polypeptide, wherein the portion comprises a position corresponding to: position 141,048 according to SEQ ID NO:4 or the complement thereof, position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, position 3,163 according to SEQ ID NO:38 or the complement thereof, position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, position 3,163 according to SEQ ID NO:69 or the complement thereof, or position 73,039 according to SEQ ID NO:5 or the complement thereof.

The present disclosure also provides molecular complexes comprising an alteration-specific primer or an alteration-specific probe hybridized to a genomic nucleic acid molecule comprising a nucleotide sequence encoding a human ARHGEF12 polypeptide, wherein the alteration-specific primer or the alteration-specific probe is hybridized to: a thymine at a position corresponding to position 141,048 according to SEQ ID NO:4, or the complement thereof; or an adenine at a position corresponding to position 73,039 according to SEQ ID NO:5, or the complement thereof.

The present disclosure also provides molecular complexes comprising an alteration-specific primer or an alteration-specific probe hybridized to an mRNA molecule comprising a nucleotide sequence encoding a human ARHGEF12 polypeptide, wherein the alteration-specific primer or the alteration-specific probe is hybridized to a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38, or the complement thereof.

The present disclosure also provides molecular complexes comprising an alteration-specific primer or an alteration-specific probe hybridized to a cDNA molecule comprising a nucleotide sequence encoding a human ARHGEF12 polypeptide, wherein the alteration-specific primer or the alteration-specific probe is hybridized to a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof.

The present disclosure also provides isolated nucleic acid molecules comprising a nucleotide sequence encoding a human ARHGEF12 polypeptide, or the complement thereof, wherein the polypeptide terminates at a position corresponding to: position 1,155 according to SEQ ID NO:81, position 1,136 according to SEQ ID NO:82, or position 1,052 according to SEQ ID NO:83.

The present disclosure also provides isolated genomic nucleic acid molecules comprising a nucleotide sequence encoding a human ARHGEF12 polypeptide, wherein the nucleotide sequence comprises: a thymine at a position corresponding to position 141,048 according to SEQ ID NO:4, or the complement thereof; or an adenine at a position corresponding to position 73,039 according to SEQ ID NO:5, or the complement thereof.

The present disclosure also provides isolated mRNA molecules comprising a nucleotide sequence encoding a human ARHGEF12 polypeptide, wherein the nucleotide sequence comprises a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof.

The present disclosure also provides isolated cDNA molecules comprising a nucleotide sequence encoding a human ARHGEF12 polypeptide, wherein the nucleotide sequence comprises a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof.

The present disclosure also provides isolated human ARHGEF12 polypeptides having an amino acid sequence: at least about 90% identical to SEQ ID NO:81, wherein the polypeptide terminates at a position corresponding to position 1,155 according to SEQ ID NO:81; at least about 90% identical to SEQ ID NO:82, wherein the polypeptide terminates at a position corresponding to position 1,136 according to SEQ ID NO:82; or at least about 90% identical to SEQ ID NO:83, wherein the polypeptide terminates at a position corresponding to position 1,052 according to SEQ ID NO:83.

The present disclosure also provides therapeutic agents that treat or inhibit glaucoma or elevated IOP for use in the treatment of glaucoma or elevated IOP in a subject having: i) a genomic nucleic acid molecule having a nucleotide sequence encoding a human ARHGEF12 polypeptide, wherein the nucleotide sequence comprises: a thymine at a position corresponding to position 132,939 according to SEQ ID NO:2, or the complement thereof; a guanine at a position corresponding to position 143,698 according to SEQ ID NO:3, or the complement thereof; a thymine at a position corresponding to position 141,048 according to SEQ ID NO:4, or the complement thereof; an adenine at a position corresponding to position 73,039 according to SEQ ID NO:5, or the complement thereof; a cytosine at a position corresponding to position 121,307 according to SEQ ID NO:6, or the complement thereof; or a cytosine at a position corresponding to position 141,978 according to SEQ ID NO:7, or the complement thereof; ii) an mRNA molecule having a nucleotide sequence encoding a human ARHGEF12 polypeptide, wherein the nucleotide sequence comprises: a uracil at a position corresponding to position 3,749 according to SEQ ID NO:16, or the complement thereof; a uracil at a position corresponding to position 3,191 according to SEQ ID NO:17, or the complement thereof; a uracil at a position corresponding to position 3,079 according to SEQ ID NO:18, or the complement thereof; a uracil at a position corresponding to position 3,692 according to SEQ ID NO:19, or the complement thereof; a uracil at a position corresponding to position 3,046 according to SEQ ID NO:20, or the complement thereof; a uracil at a position corresponding to position 2,925 according to SEQ ID NO:21, or the complement thereof; a uracil at a position corresponding to position 3,054 according to SEQ ID NO:22, or the complement thereof; a uracil at a position corresponding to position 2,615 according to SEQ ID NO:23, or the complement thereof; a guanine at a position corresponding to position 4,748 according to SEQ ID NO:24, or the complement thereof; a guanine at a position corresponding to position 4,190 according to SEQ ID NO:25, or the complement thereof; a guanine at a position corresponding to position 4,078 according to SEQ ID NO:26, or the complement thereof; a guanine at a position corresponding to position 4,691 according to SEQ ID NO:27, or the complement thereof; a guanine at a position corresponding to position 4,045 according to SEQ ID NO:28, or the complement thereof; a guanine at a position corresponding to position 3,924 according to SEQ ID NO:29, or the complement thereof; a guanine at a position corresponding to position 3,614 according to SEQ ID NO:30, or the complement thereof; a uracil at a position corresponding to position 4,297 according to SEQ ID NO:31, or the complement thereof; a uracil at a position corresponding to position 3,739 according to SEQ ID NO:32, or the complement thereof; a uracil at a position corresponding to position 3,627 according to SEQ ID NO:33, or the complement thereof; a uracil at a position corresponding to position 4,240 according to SEQ ID NO:34, or the complement thereof; a uracil at a position corresponding to position 3,594 according to SEQ ID NO:35, or the complement thereof; a uracil at a position corresponding to position 3,473 according to SEQ ID NO:36, or the complement thereof; a uracil at a position corresponding to position 3,602 according to SEQ ID NO:37, or the complement thereof; or a uracil at a position corresponding to position 3,163 according to SEQ ID NO:38, or the complement thereof; or iii) a cDNA molecule having a nucleotide sequence encoding a human ARHGEF12 polypeptide, wherein the nucleotide sequence comprises: a thymine at a position corresponding to position 3,749 according to SEQ ID NO:47, or the complement thereof; a thymine at a position corresponding to position 3,191 according to SEQ ID NO:48, or the complement thereof; a thymine at a position corresponding to position 3,079 according to SEQ ID NO:49, or the complement thereof; a thymine at a position corresponding to position 3,692 according to SEQ ID NO:50, or the complement thereof; a thymine at a position corresponding to position 3,046 according to SEQ ID NO:51, or the complement thereof; a thymine at a position corresponding to position 2,925 according to SEQ ID NO:52, or the complement thereof; a thymine at a position corresponding to position 3,054 according to SEQ ID NO:53, or the complement thereof; a thymine at a position corresponding to position 2,615 according to SEQ ID NO:54, or the complement thereof; a guanine at a position corresponding to position 4,748 according to SEQ ID NO:55, or the complement thereof; a guanine at a position corresponding to position 4,190 according to SEQ ID NO:56, or the complement thereof; a guanine at a position corresponding to position 4,078 according to SEQ ID NO:57, or the complement thereof; a guanine at a position corresponding to position 4,691 according to SEQ ID NO:58, or the complement thereof; a guanine at a position corresponding to position 4,045 according to SEQ ID NO:59, or the complement thereof; a guanine at a position corresponding to position 3,924 according to SEQ ID NO:60, or the complement thereof; a guanine at a position corresponding to position 3,614 according to SEQ ID NO:61, or the complement thereof; a thymine at a position corresponding to position 4,297 according to SEQ ID NO:62, or the complement thereof; a thymine at a position corresponding to position 3,379 according to SEQ ID NO:63, or the complement thereof; a thymine at a position corresponding to position 3,627 according to SEQ ID NO:64, or the complement thereof; a thymine at a position corresponding to position 4,240 according to SEQ ID NO:65, or the complement thereof; a thymine at a position corresponding to position 3,594 according to SEQ ID NO:66, or the complement thereof; a thymine at a position corresponding to position 3,473 according to SEQ ID NO:67, or the complement thereof; a thymine at a position corresponding to position 3,602 according to SEQ ID NO:68, or the complement thereof; or a thymine at a position corresponding to position 3,163 according to SEQ ID NO:69, or the complement thereof.

The present disclosure also provides ARHGEF12 inhibitors for use in the treatment of glaucoma or elevated IOP in a human subject having: i) a genomic nucleic acid molecule having a nucleotide sequence encoding a human ARHGEF12 polypeptide, wherein the nucleotide sequence comprises: a thymine at a position corresponding to position 132,939 according to SEQ ID NO:2, or the complement thereof; a guanine at a position corresponding to position 143,698 according to SEQ ID NO:3, or the complement thereof; a thymine at a position corresponding to position 141,048 according to SEQ ID NO:4, or the complement thereof; an adenine at a position corresponding to position 73,039 according to SEQ ID NO:5, or the complement thereof; a cytosine at a position corresponding to position 121,307 according to SEQ ID NO:6, or the complement thereof; or a cytosine at a position corresponding to position 141,978 according to SEQ ID NO:7, or the complement thereof; ii) an mRNA molecule having a nucleotide sequence encoding a human ARHGEF12 polypeptide, wherein the nucleotide sequence comprises: a uracil at a position corresponding to position 3,749 according to SEQ ID NO:16, or the complement thereof; a uracil at a position corresponding to position 3,191 according to SEQ ID NO:17, or the complement thereof; a uracil at a position corresponding to position 3,079 according to SEQ ID NO:18, or the complement thereof; a uracil at a position corresponding to position 3,692 according to SEQ ID NO:19, or the complement thereof; a uracil at a position corresponding to position 3,046 according to SEQ ID NO:20, or the complement thereof; a uracil at a position corresponding to position 2,925 according to SEQ ID NO:21, or the complement thereof; a uracil at a position corresponding to position 3,054 according to SEQ ID NO:22, or the complement thereof; a uracil at a position corresponding to position 2,615 according to SEQ ID NO:23, or the complement thereof; a guanine at a position corresponding to position 4,748 according to SEQ ID NO:24, or the complement thereof; a guanine at a position corresponding to position 4,190 according to SEQ ID NO:25, or the complement thereof; a guanine at a position corresponding to position 4,078 according to SEQ ID NO:26, or the complement thereof; a guanine at a position corresponding to position 4,691 according to SEQ ID NO:27, or the complement thereof; a guanine at a position corresponding to position 4,045 according to SEQ ID NO:28, or the complement thereof; a guanine at a position corresponding to position 3,924 according to SEQ ID NO:29, or the complement thereof; a guanine at a position corresponding to position 3,614 according to SEQ ID NO:30, or the complement thereof; a uracil at a position corresponding to position 4,297 according to SEQ ID NO:31, or the complement thereof; a uracil at a position corresponding to position 3,739 according to SEQ ID NO:32, or the complement thereof; a uracil at a position corresponding to position 3,627 according to SEQ ID NO:33, or the complement thereof; a uracil at a position corresponding to position 4,240 according to SEQ ID NO:34, or the complement thereof; a uracil at a position corresponding to position 3,594 according to SEQ ID NO:35, or the complement thereof; a uracil at a position corresponding to position 3,473 according to SEQ ID NO:36, or the complement thereof; a uracil at a position corresponding to position 3,602 according to SEQ ID NO:37, or the complement thereof; or a uracil at a position corresponding to position 3,163 according to SEQ ID NO:38, or the complement thereof; or iii) a cDNA molecule having a nucleotide sequence encoding a human ARHGEF12 polypeptide, wherein the nucleotide sequence comprises: a thymine at a position corresponding to position 3,749 according to SEQ ID NO:47, or the complement thereof; a thymine at a position corresponding to position 3,191 according to SEQ ID NO:48, or the complement thereof; a thymine at a position corresponding to position 3,079 according to SEQ ID NO:49, or the complement thereof; a thymine at a position corresponding to position 3,692 according to SEQ ID NO:50, or the complement thereof; a thymine at a position corresponding to position 3,046 according to SEQ ID NO:51, or the complement thereof; a thymine at a position corresponding to position 2,925 according to SEQ ID NO:52, or the complement thereof; a thymine at a position corresponding to position 3,054 according to SEQ ID NO:53, or the complement thereof; a thymine at a position corresponding to position 2,615 according to SEQ ID NO:54, or the complement thereof; a guanine at a position corresponding to position 4,748 according to SEQ ID NO:55, or the complement thereof; a guanine at a position corresponding to position 4,190 according to SEQ ID NO:56, or the complement thereof; a guanine at a position corresponding to position 4,078 according to SEQ ID NO:57, or the complement thereof; a guanine at a position corresponding to position 4,691 according to SEQ ID NO:58, or the complement thereof; a guanine at a position corresponding to position 4,045 according to SEQ ID NO:59, or the complement thereof; a guanine at a position corresponding to position 3,924 according to SEQ ID NO:60, or the complement thereof; a guanine at a position corresponding to position 3,614 according to SEQ ID NO:61, or the complement thereof; a thymine at a position corresponding to position 4,297 according to SEQ ID NO:62, or the complement thereof; a thymine at a position corresponding to position 3,379 according to SEQ ID NO:63, or the complement thereof; a thymine at a position corresponding to position 3,627 according to SEQ ID NO:64, or the complement thereof; a thymine at a position corresponding to position 4,240 according to SEQ ID NO:65, or the complement thereof; a thymine at a position corresponding to position 3,594 according to SEQ ID NO:66, or the complement thereof; a thymine at a position corresponding to position 3,473 according to SEQ ID NO:67, or the complement thereof; a thymine at a position corresponding to position 3,602 according to SEQ ID NO:68, or the complement thereof; or a thymine at a position corresponding to position 3,163 according to SEQ ID NO:69, or the complement thereof.

BRIEF DESCRIPTION OF THE DRAWINGS

The accompanying figures, which are incorporated in and constitute a part of this specification, illustrate several features of the present disclosure.

DESCRIPTION

Figure 1A:
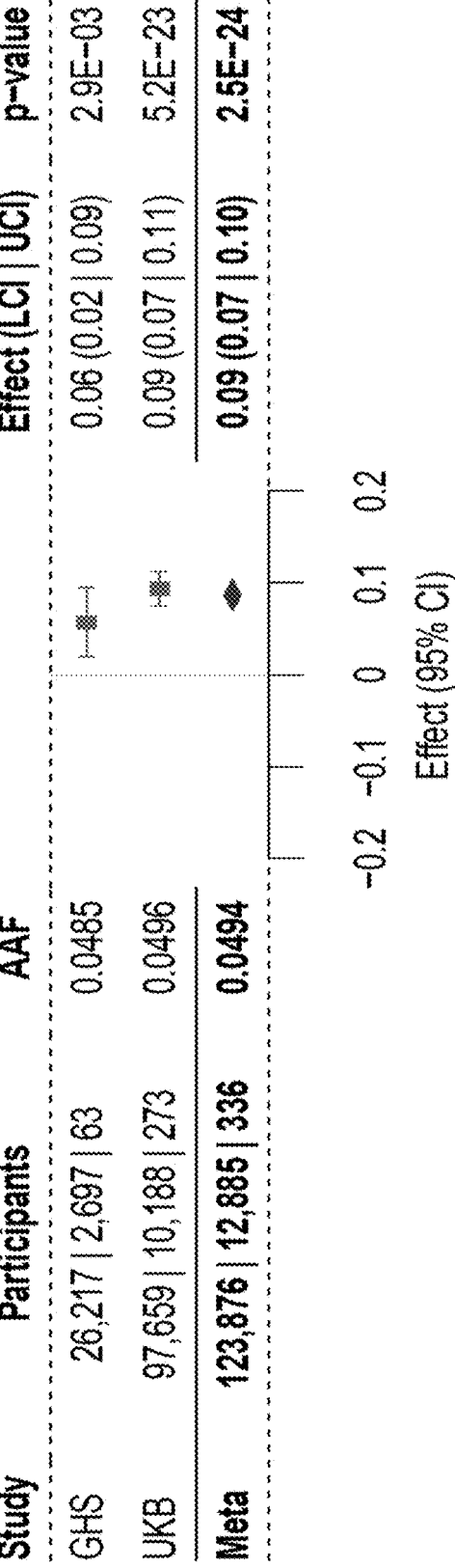
FIG. 1A depicts a missense variant in ARHGEF12 (Tyr973Phe) associated with an increase in IOP.

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is in no way intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the term "isolated", in regard to a nucleic acid molecule or a polypeptide, means that the nucleic acid molecule or polypeptide is in a condition other than its native environment, such as apart from blood and/or animal tissue. In some embodiments, an isolated nucleic acid molecule or polypeptide is substantially free of other nucleic acid molecules or other polypeptides, particularly other nucleic acid molecules or polypeptides of animal origin. In some embodiments, the nucleic acid molecule or polypeptide can be in a highly purified form, i.e., greater than 95% pure or greater than 99% pure. When used in this context, the term "isolated" does not exclude the presence of the same nucleic acid molecule or polypeptide in alternative physical forms, such as dimers or alternatively phosphorylated or derivatized forms.

As used herein, the terms "nucleic acid", "nucleic acid molecule", "nucleic acid sequence", "polynucleotide", or "oligonucleotide" can comprise a polymeric form of nucleotides of any length, can comprise DNA and/or RNA, and can be single-stranded, double-stranded, or multiple stranded. One strand of a nucleic acid also refers to its complement.

As used herein, the term "subject" includes any animal, including mammals. Mammals include, but are not limited to, farm animals (such as, for example, horse, cow, pig), companion animals (such as, for example, dog, cat), laboratory animals (such as, for example, mouse, rat, rabbits), and non-human primates. In some embodiments, the subject is a human. In some embodiments, the subject is a patient under the care of a physician.

A rare variant in the ARHGEF12 gene associated with an increased risk of developing glaucoma and elevated IOP in subjects has been identified in accordance with the present disclosure. For example, a genetic alteration that changes the adenine nucleotide of position 132,939 in the human ARHGEF12 reference genomic nucleic acid molecule (see, SEQ ID NO:1) to thymine has been observed to indicate that the human having such an alteration may have an increased risk of developing glaucoma and elevated IOP.

Another rare variant in the ARHGEF12 gene associated with a decreased risk of developing glaucoma and elevated IOP in subjects has also been identified in accordance with the present disclosure. For example, a genetic alteration that changes the adenine nucleotide of position 143,698 in the human ARHGEF12 reference genomic nucleic acid molecule (see, SEQ ID NO:1) to guanine, or changes the guanine nucleotide of position 141,048 in the human ARHGEF12 reference genomic nucleic acid molecule (see, SEQ ID NO:1) to thymine, or changes the guanine nucleotide of position 73,039 in the human ARHGEF12 reference genomic nucleic acid molecule (see, SEQ ID NO:1) to adenine, or changes the adenine nucleotide of position 121,307 in the human ARHGEF12 reference genomic nucleic acid molecule (see, SEQ ID NO:1) to cytosine, or changes the guanine nucleotide of position 141,978 in the human ARHGEF12 reference genomic nucleic acid molecule (see, SEQ ID NO:1) to cytosine has been observed to indicate that the human having such an alteration may have a decreased risk of developing glaucoma and elevated IOP.

It is believed that no ARHGEF12 predicted loss-of-function variants have any known association with lower IOP. Altogether, the genetic analyses described herein surprisingly indicate that the ARHGEF12 gene and, in particular, variants in the ARHGEF12 gene, associates with an increased or decreased risk of developing glaucoma and elevated IOP. Therefore, subjects that are ARHGEF12 reference that have an increased risk of developing glaucoma and elevated IOP, may be treated such that glaucoma and/or elevated IOP is prevented, the symptoms thereof are reduced, and/or development of symptoms is repressed. Accordingly, the present disclosure provides methods of leveraging the identification of such variants in subjects to identify or stratify risk in such subjects of developing glaucoma and elevated IOP, or to diagnose subjects as having an increased risk of developing glaucoma and elevated IOP, such that subjects at risk or subjects with active disease may be treated accordingly. Additionally, the present disclosure provides isolated ARHGEF12 variant genomic nucleic acid molecules, variant mRNA molecules, and variant cDNA molecules.

For purposes of the present disclosure, any particular human can be categorized as having one of five ARHGEF12 genotypes: i) ARHGEF12 reference; ii) heterozygous for an ARHGEF12 predicted loss-of-function variant; iii) homozygous for an ARHGEF12 predicted loss-of-function variant; iv) heterozygous for an ARHGEF12 predicted gain-of-function variant; or v) homozygous for an ARHGEF12 predicted gain-of-function variant. A human is ARHGEF12 reference when the human does not have a copy of an ARHGEF12 predicted loss-of-function variant nucleic acid molecule or an ARHGEF12 predicted gain-of-function variant molecule. A human is heterozygous for an ARHGEF12 predicted loss-of-function variant when the human has a single copy of an ARHGEF12 predicted loss-of-function variant nucleic acid molecule. A human is heterozygous for an ARHGEF12 predicted gain-of-function variant when the human has a single copy of an ARHGEF12 predicted gain-of-function variant nucleic acid molecule. As used herein, an ARHGEF12 predicted loss-of-function variant nucleic acid molecule is any ARHGEF12 nucleic acid molecule (such as, a genomic nucleic acid molecule, an mRNA molecule, or a cDNA molecule) encoding an ARHGEF12 polypeptide having a partial loss-of-function, a complete loss-of-function, a predicted partial loss-of-function, or a predicted complete loss-of-function. As used herein, an ARHGEF12 predicted gain-of-function variant nucleic acid molecule is any ARHGEF12 nucleic acid molecule (such as, a genomic nucleic acid molecule, an mRNA molecule, or a cDNA molecule) encoding an ARHGEF12 polypeptide having an enhanced activity, a constitutive activity, an increased ability to cause disease, a decreased ability to resist disease, resistance to an inhibitor, or resistance to a therapeutic intervention. A human who has an ARHGEF12 polypeptide having a partial loss-of-function (or predicted partial loss-of-function) is hypomorphic for ARHGEF12. A human is homozygous for an ARHGEF12 predicted loss-of-function variant when the human has two copies of an ARHGEF12 predicted loss-of-function variant nucleic acid molecule. A human is homozygous for an ARHGEF12 predicted gain-of-function variant when the human has two copies of an ARHGEF12 predicted gain-of-function variant nucleic acid molecule.

For subjects that are genotyped or determined to be ARHGEF12 reference, such subjects have an increased risk of developing glaucoma and/or developing elevated IOP. Such subjects can be administered or continued to be administered a therapeutic agent that treats or inhibits glaucoma or elevated IOP in a standard dosage amount, and/or administered an ARHGEF12 inhibitor.

For subjects that are genotyped or determined to be heterozygous for an ARHGEF12 predicted gain-of-function variant, such subjects have an increased risk of developing glaucoma and/or developing elevated IOP. Such subjects can be administered or continued to be administered a therapeutic agent that treats or inhibits glaucoma or elevated IOP in an amount that is the same as or greater than a standard dosage amount, and/or administered an ARHGEF12 inhibitor.

For subjects that are genotyped or determined to be heterozygous for an ARHGEF12 predicted loss-of-function variant, such subjects have a decreased risk of developing glaucoma and/or developing elevated IOP. Such subjects can be administered or continued to be administered a therapeutic agent that treats or inhibits glaucoma or elevated IOP in an amount that is the same as or less than a standard dosage amount, and/or administered an ARHGEF12 inhibitor.

In any of the embodiments described herein, the ARHGEF12 predicted loss-of-function variant nucleic acid molecule can be any ARHGEF12 nucleic acid molecule (such as, for example, genomic nucleic acid molecule, mRNA molecule, or cDNA molecule) encoding an ARHGEF12 polypeptide having a partial loss-of-function, a complete loss-of-function, a predicted partial loss-of-function, or a predicted complete loss-of-function. In some embodiments, the ARHGEF12 predicted loss-of-function variant nucleic acid molecule is a nucleic acid molecule encoding ARHGEF12 Tyr1306Cys, Tyr1287Cys, Tyr1203Cys, Glu1156STOP, Glu1137STOP, or Glu1053STOP. In some embodiments, the ARHGEF12 predicted loss-of-function variant nucleic acid molecule is a nucleic acid molecule encoding ARHGEF12 Tyr1306Cys. In some embodiments, the ARHGEF12 predicted loss-of-function variant nucleic acid molecule is a nucleic acid molecule encoding ARHGEF12 Tyr1287Cys. In some embodiments, the ARHGEF12 predicted loss-of-function variant nucleic acid molecule is a nucleic acid molecule encoding ARHGEF12 Tyr1203Cys. In some embodiments, the ARHGEF12 predicted loss-of-function variant nucleic acid molecule is a nucleic acid molecule encoding ARHGEF12 Glu1156STOP. In some embodiments, the ARHGEF12 predicted loss-of-function variant nucleic acid molecule is a nucleic acid molecule encoding ARHGEF12 Glu1137STOP. In some embodiments, the ARHGEF12 predicted loss-of-function variant nucleic acid molecule is a nucleic acid molecule encoding ARHGEF12 Glu1053STOP.

In any of the embodiments described herein, the ARHGEF12 predicted gain-of-function variant nucleic acid molecule can be any ARHGEF12 nucleic acid molecule (such as, for example, genomic nucleic acid molecule, mRNA molecule, or cDNA molecule) encoding an ARHGEF12 polypeptide having gain-of-function. In some embodiments, the ARHGEF12 predicted gain-of-function variant nucleic acid molecule is a nucleic acid molecule encoding ARHGEF12 Tyr973Phe, Tyr954Phe, or Tyr870Phe. In some embodiments, the ARHGEF12 predicted gain-of-function variant nucleic acid molecule is a nucleic acid molecule encoding ARHGEF12 Tyr973Phe. In some embodiments, the ARHGEF12 predicted gain-of-function variant nucleic acid molecule is a nucleic acid molecule encoding ARHGEF12 Tyr954Phe. In some embodiments, the ARHGEF12 predicted gain-of-function variant nucleic acid molecule is a nucleic acid molecule encoding ARHGEF12 Tyr870Phe.

In any of the embodiments described herein, the ARHGEF12 predicted loss-of-function polypeptide can be any ARHGEF12 polypeptide having a partial loss-of-function, a complete loss-of-function, a predicted partial loss-of-function, or a predicted complete loss-of-function. In some embodiments, the ARHGEF12 predicted loss-of-function polypeptide is ARHGEF12 Tyr1306Cys, Tyr1287Cys, Tyr1203Cys, Glu1156STOP, Glu1137STOP, or Glu1053STOP. In some embodiments, the ARHGEF12 predicted loss-of-function polypeptide is ARHGEF12 Tyr1306Cys. In some embodiments, the ARHGEF12 predicted loss-of-function polypeptide is ARHGEF12 Tyr1287Cys. In some embodiments, the ARHGEF12 predicted loss-of-function polypeptide is ARHGEF12 Tyr1203Cys. In some embodiments, the ARHGEF12 predicted loss-of-function polypeptide is ARHGEF12 Glu1156STOP. In some embodiments, the ARHGEF12 predicted loss-of-function polypeptide is ARHGEF12 Glu1137STOP. In some embodiments, the ARHGEF12 predicted loss-of-function polypeptide is ARHGEF12 Glu1053STOP.

In any of the embodiments described herein, the ARHGEF12 predicted gain-of-function polypeptide can be any ARHGEF12 polypeptide having a gain-of-function. In some embodiments, the ARHGEF12 predicted gain-of-function polypeptide is ARHGEF12 Tyr973Phe, Tyr954Phe, or Tyr870Phe. In some embodiments, the ARHGEF12 predicted gain-of-function polypeptide is ARHGEF12 Tyr973Phe. In some embodiments, the ARHGEF12 predicted gain-of-function polypeptide is ARHGEF12 Tyr954Phe. In some embodiments, the ARHGEF12 predicted gain-of-function polypeptide is ARHGEF12 Tyr870Phe.

In any of the embodiments described herein, the subject can have glaucoma. In any of the embodiments described herein, the glaucoma can be primary open-angle glaucoma (POAG). In any of the embodiments described herein, the subject can have elevated IOP.

Symptoms of glaucoma include, but are not limited to, severe headache, eye pain, nausea and vomiting, blurred vision, halos around lights, and eye redness.

The present disclosure provides methods of treating a subject having glaucoma, the methods comprising administering an ARHGEF12 inhibitor to the subject.

The present disclosure also provides methods of treating a subject having primary open-angle glaucoma (POAG), the methods comprising administering an ARHGEF12 inhibitor to the subject.

The present disclosure also provides methods of treating a subject having elevated IOP, the methods comprising administering an ARHGEF12 inhibitor to the subject.

In some embodiments, the ARHGEF12 inhibitor comprises an inhibitory nucleic acid molecule. In some embodiments, the inhibitory nucleic acid molecule comprises an antisense molecule. In some embodiments, the inhibitory nucleic acid molecule comprises a small interfering RNA (siRNA) molecule. In some embodiments, the inhibitory nucleic acid molecule comprises a short hairpin RNA (shRNA) molecule. Such inhibitory nucleic acid molecules can be designed to target any region of an ARHGEF12 mRNA. In some embodiments, the inhibitory nucleic acid molecule hybridizes to a sequence within an ARHGEF12 genomic nucleic acid molecule or mRNA molecule and decreases expression of the ARHGEF12 polypeptide in a cell in the subject. In some embodiments, the ARHGEF12 inhibitor comprises an antisense RNA that hybridizes to an ARHGEF12 genomic nucleic acid molecule or mRNA molecule and decreases expression of the ARHGEF12 polypeptide in a cell in the subject. In some embodiments, the ARHGEF12 inhibitor comprises an siRNA that hybridizes to an ARHGEF12 genomic nucleic acid molecule or mRNA molecule and decreases expression of the ARHGEF12 polypeptide in a cell in the subject. In some embodiments, the ARHGEF12 inhibitor comprises an shRNA that hybridizes to an ARHGEF12 genomic nucleic acid molecule or mRNA molecule and decreases expression of the ARHGEF12 polypeptide in a cell in the subject.

In some embodiments, the ARHGEF12 inhibitor comprises a nuclease agent that induces one or more nicks or double-strand breaks at a recognition sequence(s) or a DNA-binding protein that binds to a recognition sequence within an ARHGEF12 genomic nucleic acid molecule. The recognition sequence can be located within a coding region of the ARHGEF12 gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the ARHGEF12 gene. For example, the recognition sequence can be located about 10, about 20, about 30, about 40, about 50, about 100, about 200, about 300, about 400, about 500, or about 1,000 nucleotides from the start codon. As another example, two or more nuclease agents can be used, each targeting a nuclease recognition sequence including or proximate to the start codon. As another example, two nuclease agents can be used, one targeting a nuclease recognition sequence including or proximate to the start codon, and one targeting a nuclease recognition sequence including or proximate to the stop codon, wherein cleavage by the nuclease agents can result in deletion of the coding region between the two nuclease recognition sequences. Any nuclease agent that induces a nick or double-strand break into a desired recognition sequence can be used in the methods and compositions disclosed herein. Any DNA-binding protein that binds to a desired recognition sequence can be used in the methods and compositions disclosed herein.

Suitable nuclease agents and DNA-binding proteins for use herein include, but are not limited to, zinc finger protein or zinc finger nuclease (ZFN) pair, Transcription Activator-Like Effector (TALE) protein or Transcription Activator-Like Effector Nuclease (TALEN), or Clustered Regularly Interspersed Short Palindromic Repeats (CRISPR)/CRISPR-associated (Cas) systems. The length of the recognition sequence can vary, and includes, for example, recognition sequences that are about 30-36 bp for a zinc finger protein or ZFN pair, about 15-18 bp for each ZFN, about 36 bp for a TALE protein or TALEN, and about 20 bp for a CRISPR/Cas guide RNA.

In some embodiments, CRISPR/Cas systems can be used to modify an ARHGEF12 genomic nucleic acid molecule within a cell. The methods and compositions disclosed herein can employ CRISPR-Cas systems by utilizing CRISPR complexes (comprising a guide RNA (gRNA) complexed with a Cas protein) for site-directed cleavage of ARHGEF12 nucleic acid molecules.

Cas proteins generally comprise at least one RNA recognition or binding domain that can interact with gRNAs. Cas proteins can also comprise nuclease domains (such as, for example, DNase or RNase domains), DNA binding domains, helicase domains, protein-protein interaction domains, dimerization domains, and other domains. Suitable Cas proteins include, for example, a wild type Cas9 protein and a wild type Cpf1 protein (such as, for example, FnCpf1). A Cas protein can have full cleavage activity to create a double-strand break in an ARHGEF12 genomic nucleic acid molecule or it can be a nickase that creates a single-strand break in an ARHGEF12 genomic nucleic acid molecule. Additional examples of Cas proteins include, but are not limited to, Cas1, Cas1B, Cast, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (Cas6), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof. Cas proteins can also be operably linked to heterologous polypeptides as fusion proteins. For example, a Cas protein can be fused to a cleavage domain, an epigenetic modification domain, a transcriptional activation domain, or a transcriptional repressor domain. Cas proteins can be provided in any form. For example, a Cas protein can be provided in the form of a protein, such as a Cas protein complexed with a gRNA. Alternately, a Cas protein can be provided in the form of a nucleic acid molecule encoding the Cas protein, such as an RNA or DNA.

In some embodiments, targeted genetic modifications of ARHGEF12 genomic nucleic acid molecules can be generated by contacting a cell with a Cas protein and one or more gRNAs that hybridize to one or more gRNA recognition sequences within a target genomic locus in the ARHGEF12 genomic nucleic acid molecule. For example, a gRNA recognition sequence can be located within a region of SEQ ID NO:1. The gRNA recognition sequence can also include or be proximate to a position corresponding to: position 132,939, position 143,698, position 141,048, position 73,039, position 121,307, or position 141,978 according to SEQ ID NO:1. For example, the gRNA recognition sequence can be located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to: position 132,939, position 143, 698, position 141,048, position 73,039, position 121,307, position 141,978 according to SEQ ID NO:1. The gRNA recognition sequence can include or be proximate to the start codon of an ARHGEF12 genomic nucleic acid molecule or the stop codon of an ARHGEF12 genomic nucleic acid molecule. For example, the gRNA recognition sequence can be located from about 10, from about 20, from about 30, from about 40, from about 50, from about 100, from about 200, from about 300, from about 400, from about 500, or from about 1,000 nucleotides of the start codon or the stop codon.

The gRNA recognition sequences within a target genomic locus in an ARHGEF12 genomic nucleic acid molecule are located near a Protospacer Adjacent Motif (PAM) sequence, which is a 2-6 base pair DNA sequence immediately following the DNA sequence targeted by the Cas9 nuclease. The canonical PAM is the sequence 5'-NGG-3' where "N" is any nucleobase followed by two guanine ("G") nucleobases. gRNAs can transport Cas9 to anywhere in the genome for gene editing, but no editing can occur at any site other than one at which Cas9 recognizes PAM. In addition, 5'-NGA-3' can be a highly efficient non-canonical PAM for human cells. Generally, the PAM is about 2-6 nucleotides downstream of the DNA sequence targeted by the gRNA. The PAM can flank the gRNA recognition sequence. In some embodiments, the gRNA recognition sequence can be flanked on the 3' end by the PAM. In some embodiments, the gRNA recognition sequence can be flanked on the 5' end by the PAM. For example, the cleavage site of Cas proteins can be about 1 to about 10, about 2 to about 5 base pairs, or three base pairs upstream or downstream of the PAM sequence. In some embodiments (such as when Cas9 from *S. pyogenes* or a closely related Cas9 is used), the PAM sequence of the non-complementary strand can be 5'-NGG-3', where N is any DNA nucleotide and is immediately 3' of the gRNA recognition sequence of the non-complementary strand of the target DNA. As such, the PAM sequence of the complementary strand would be 5'-CCN-3', where N is any DNA nucleotide and is immediately 5' of the gRNA recognition sequence of the complementary strand of the target DNA.

A gRNA is an RNA molecule that binds to a Cas protein and targets the Cas protein to a specific location within an ARHGEF12 genomic nucleic acid molecule. An exemplary gRNA is a gRNA effective to direct a Cas enzyme to bind to or cleave an ARHGEF12 genomic nucleic acid molecule, wherein the gRNA comprises a DNA-targeting segment that hybridizes to a gRNA recognition sequence within the ARHGEF12 genomic nucleic acid molecule that includes or is proximate to a position corresponding to: position 132, 939, position 143,698, position 141,048, position 73,039, position 121,307, or position 141,978 according to SEQ ID NO:1. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of a position corresponding to: position 132,939, position 143,698, position 141,048, position 73,039, position 121,307, or position 141,978 according to SEQ ID NO:1. Other exemplary gRNAs comprise a DNA-targeting segment that hybridizes to a gRNA recognition sequence present within an ARHGEF12 genomic nucleic acid molecule that includes or is proximate to the start codon or the stop codon. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the start codon or located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs can comprise 20 nucleotides.

Examples of suitable gRNA recognition sequences located within the human ARHGEF12 reference gene are set forth in Table 1 as SEQ ID NOs:84-110.

TABLE 1

| Guide RNA Recognition Sequences Near ARHGEF12 Variation(s) | | |
| --- | --- | --- |
| Strand | gRNA Recognition Sequence | SEQ ID NO: |
| − | GGCGACGCTGATAATCTTCT | 84 |
| − | GTACTCTGACAACTTCAGGC | 85 |
| + | TACTAAGTACCCACTTCTGT | 86 |
| − | TTGGGTACTCTGACAACTTC | 87 |
| − | ACTTCAGGCTGGAGGTATCA | 88 |
| + | ACCCAAATGTTGAAGAGCTC | 89 |
| − | AAACCCAGCCACACGAGACC | 90 |
| + | GCAGGACCTAATCTGTCGGA | 91 |
| − | ATGCAGCCATCCGACAGATT | 92 |
| + | CCACAGTCAACACCTGGCGA | 93 |
| − | TCATCATTATCTCCTTCGCC | 94 |
| + | TCGGATGGCTGCATCAGTGA | 95 |
| − | CCTTCGCCAGGTGTTGACTG | 96 |
| − | TCTAATCCCAAATCTCTGTC | 97 |
| + | CCATTACCACAGTCAACACC | 98 |
| + | CAGCATGGCATTTCAGTCAC | 99 |
| + | TTTGACTGAGAAGAGCGTTC | 100 |
| + | TTTTGCTCCACGGGATTCAG | 101 |
| + | TCCACGGGATTCAGTGGGAC | 102 |
| + | TTTGCTCCACGGGATTCAGT | 103 |
| − | GCCAGTCCCACTGAATCCCG | 104 |
| + | AATATTAAGGCCTATCATTC | 105 |

TABLE 1-continued

| Guide RNA Recognition Sequences Near ARHGEF12 Variation(s) | | |
| Strand | gRNA Recognition Sequence | SEQ ID NO: |
| --- | --- | --- |
| − | AAAGATTCAGTTGAAGTCCG | 106 |
| + | TTGCAACTTGTTACAGTCCA | 107 |
| + | GGACATATGCCCTTTAGAAC | 108 |
| + | TTCAGTGGGACTGGCACCCC | 109 |
| + | AACTGAATCTTTTGCTCCAC | 110 |

The Cas protein and the gRNA form a complex, and the Cas protein cleaves the target ARHGEF12 genomic nucleic acid molecule. The Cas protein can cleave the nucleic acid molecule at a site within or outside of the nucleic acid sequence present in the target ARHGEF12 genomic nucleic acid molecule to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the ARHGEF12 genomic nucleic acid molecule to which a DNA-targeting segment of a gRNA will bind.

Such methods can result, for example, in an ARHGEF12 genomic nucleic acid molecule in which a region of SEQ ID NO:1 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the ARHGEF12 genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

In some embodiments, the ARHGEF12 inhibitor comprises a small molecule. In some embodiments, the ARHGEF12 small molecule inhibitor is Y16, CCG-13528, CCG-14631, CCG-7167, CCG-12529, or RC-063.

In some embodiments, the methods of treatment further comprise detecting the presence or absence of an ARHGEF12 predicted loss-of-function variant nucleic acid molecule encoding a human ARHGEF12 polypeptide in a biological sample from the subject. As used throughout the present disclosure, a "ARHGEF12 predicted loss-of-function variant nucleic acid molecule" is any ARHGEF12 nucleic acid molecule (such as, for example, genomic nucleic acid molecule, mRNA molecule, or cDNA molecule) encoding an ARHGEF12 polypeptide having a partial loss-of-function, a complete loss-of-function, a predicted partial loss-of-function, or a predicted complete loss-of-function.

In some embodiments, the methods of treatment further comprise detecting the presence or absence of an ARHGEF12 predicted gain-of-function variant nucleic acid molecule encoding a human ARHGEF12 polypeptide in a biological sample from the subject. As used throughout the present disclosure, a "ARHGEF12 predicted gain-of-function variant nucleic acid molecule" is any ARHGEF12 nucleic acid molecule (such as, for example, genomic nucleic acid molecule, mRNA molecule, or cDNA molecule) encoding an ARHGEF12 polypeptide having an enhanced activity, a constitutive activity, an increased ability to cause disease, a decreased ability to resist disease, resistance to inhibitors, or resistance to therapeutic interventions.

The present disclosure also provides methods of treating a subject with a therapeutic agent that treats or inhibits glaucoma and/or elevated IOP, wherein the subject is suffering from glaucoma and/or elevated IOP. In some embodiments, the methods comprise determining whether the subject has an ARHGEF12 predicted loss-of-function variant nucleic acid molecule encoding a human ARHGEF12 polypeptide by obtaining or having obtained a biological sample from the subject, and performing or having performed a genotyping assay on the biological sample to determine if the subject has a genotype comprising the ARHGEF12 predicted loss-of-function variant nucleic acid molecule. When the subject is ARHGEF12 reference, the therapeutic agent that treats or inhibits glaucoma and/or elevated IOP is administered or continued to be administered to the subject in a standard dosage amount, and an ARHGEF12 inhibitor can be administered to the subject. When the subject is heterozygous for an ARHGEF12 predicted loss-of-function variant, the therapeutic agent that treats or inhibits glaucoma and/or elevated IOP is administered or continued to be administered to the subject in an amount that is the same as or lower than a standard dosage amount, and an ARHGEF12 inhibitor can be administered to the subject. The presence of a genotype having the ARHGEF12 predicted loss-of-function variant nucleic acid molecule encoding the human ARHGEF12 polypeptide indicates the subject has a reduced risk of developing glaucoma and/or elevated IOP. In some embodiments, the subject is ARHGEF12 reference. In some embodiments, the subject is heterozygous for an ARHGEF12 predicted loss-of-function variant.

The present disclosure also provides methods of treating a subject with a therapeutic agent that treats or inhibits glaucoma and/or elevated IOP, wherein the subject is suffering from glaucoma and/or elevated IOP. In some embodiments, the methods comprise determining whether the subject has an ARHGEF12 predicted gain-of-function variant nucleic acid molecule encoding a human ARHGEF12 polypeptide by obtaining or having obtained a biological sample from the subject, and performing or having performed a genotyping assay on the biological sample to determine if the subject has a genotype comprising the ARHGEF12 predicted gain-of-function variant nucleic acid molecule. When the subject is ARHGEF12 reference, the therapeutic agent that treats or inhibits glaucoma and/or elevated IOP is administered or continued to be administered to the subject in a standard dosage amount, and an ARHGEF12 inhibitor can be administered to the subject. When the subject is heterozygous for an ARHGEF12 predicted gain-of-function variant, the therapeutic agent that treats or inhibits glaucoma and/or elevated IOP is administered or continued to be administered to the subject in an amount that is greater than a standard dosage amount, and an ARHGEF12 inhibitor can administered to the subject. The presence of a genotype having the ARHGEF12 predicted gain-of-function variant nucleic acid molecule encoding the human ARHGEF12 polypeptide indicates the subject has an increased risk of developing glaucoma and/or elevated IOP. In some embodiments, the subject is ARHGEF12 reference. In some embodiments, the subject is heterozygous for an ARHGEF12 predicted gain-of-function variant.

For subjects that are genotyped or determined to be either ARHGEF12 reference, heterozygous for an ARHGEF12 predicted loss-of-function variant, or heterozygous or homozygous for an ARHGEF12 predicted gain-of-function variant, such subjects can be treated with an ARHGEF12 inhibitor, as described herein.

Detecting the presence or absence of an ARHGEF12 predicted loss-of-function variant nucleic acid molecule or an ARHGEF12 predicted gain-of-function variant nucleic acid molecule in a biological sample from a subject and/or determining whether a subject has an ARHGEF12 predicted loss-of-function variant nucleic acid molecule or an ARHGEF12 predicted gain-of-function variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, when the subject is ARHGEF12 reference, the subject is also administered a therapeutic agent that treats or inhibits glaucoma and/or elevated IOP in a standard dosage amount. In some embodiments, when the subject is heterozygous for an ARHGEF12 predicted loss-of-function variant, the subject is also administered a therapeutic agent that treats or inhibits glaucoma and/or elevated IOP in a dosage amount that is the same as or lower than a standard dosage amount. In some embodiments, when the subject is heterozygous for an ARHGEF12 predicted gain-of-function variant, the therapeutic agent that treats or inhibits glaucoma and/or elevated IOP is administered or continued to be administered to the subject in an amount that is the greater than a standard dosage amount.

In some embodiments, the treatment methods further comprise detecting the presence or absence of an ARHGEF12 predicted loss-of-function polypeptide or an ARHGEF12 predicted gain-of-function polypeptide in a biological sample from the subject. In some embodiments, when the subject does not have an ARHGEF12 predicted loss-of-function polypeptide, the subject is also administered a therapeutic agent that treats or inhibits glaucoma and/or elevated IOP in a standard dosage amount. In some embodiments, when the subject has an ARHGEF12 predicted loss-of-function polypeptide, the subject is also administered a therapeutic agent that treats or inhibits glaucoma and/or elevated IOP in a dosage amount that is the same as or lower than a standard dosage amount. In some embodiments, when the subject is heterozygous for an ARHGEF12 predicted gain-of-function polypeptide, the subject is also administered a therapeutic agent that treats or inhibits glaucoma and/or elevated IOP in a dosage amount that is greater than a standard dosage amount.

The present disclosure also provides methods of treating a subject with a therapeutic agent that treats or inhibits glaucoma and/or elevated IOP, wherein the subject is suffering from glaucoma and/or elevated IOP. In some embodiments, the method comprises determining whether the subject has an ARHGEF12 predicted loss-of-function polypeptide by obtaining or having obtained a biological sample from the subject, and performing or having performed an assay on the biological sample to determine if the subject has an ARHGEF12 predicted loss-of-function polypeptide. When the subject does not have an ARHGEF12 predicted loss-of-function polypeptide, the therapeutic agent that treats or inhibits glaucoma and/or elevated IOP is administered or continued to be administered to the subject in a standard dosage amount, and an ARHGEF12 inhibitor can be administered to the subject. When the subject has an ARHGEF12 predicted loss-of-function polypeptide, the therapeutic agent that treats or inhibits glaucoma and/or elevated IOP is administered or continued to be administered to the subject in an amount that is the same as or lower than a standard dosage amount, and an ARHGEF12 inhibitor can be administered to the subject. The presence of an ARHGEF12 predicted loss-of-function polypeptide indicates the subject has a reduced risk of developing glaucoma and/or elevated IOP. In some embodiments, the subject has an ARHGEF12 predicted loss-of-function polypeptide. In some embodiments, the subject does not have an ARHGEF12 predicted loss-of-function polypeptide.

In some embodiments, the method comprises determining whether the subject has an ARHGEF12 predicted gain-of-function polypeptide by obtaining or having obtained a biological sample from the subject, and performing or having performed an assay on the biological sample to determine if the subject has an ARHGEF12 predicted gain-of-function polypeptide. When the subject does not have an ARHGEF12 predicted gain-of-function polypeptide, the therapeutic agent that treats or inhibits glaucoma and/or elevated IOP is administered or continued to be administered to the subject in a standard dosage amount, and an ARHGEF12 inhibitor can be administered to the subject. When the subject has an ARHGEF12 predicted gain-of-function polypeptide, the therapeutic agent that treats or inhibits glaucoma and/or elevated IOP is administered or continued to be administered to the subject in an amount that is greater than a standard dosage amount, and an ARHGEF12 inhibitor can administered to the subject. The presence of an ARHGEF12 predicted gain-of-function polypeptide indicates the subject has an increased risk of developing glaucoma and/or elevated IOP. In some embodiments, the subject has an ARHGEF12 predicted gain-of-function polypeptide. In some embodiments, the subject does not have an ARHGEF12 predicted gain-of-function polypeptide.

Detecting the presence or absence of an ARHGEF12 predicted loss-of-function polypeptide or an ARHGEF12 predicted gain-of-function polypeptide in a biological sample from a subject and/or determining whether a subject has an ARHGEF12 predicted loss-of-function polypeptide or an ARHGEF12 predicted gain-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the polypeptide can be present within a cell obtained from the subject.

Examples of therapeutic agents that treat or inhibit glaucoma and/or elevated IOP include, but are not limited to: a prostaglandin, a beta blocker, an alpha-adrenergic agonist, a carbonic anhydrase inhibitor, a rho kinase inhibitor, or a miotic or cholinergic agent. In some embodiments, the agent that treats or inhibits glaucoma and/or elevated IOP is a prostaglandin. In some embodiments, the agent that treats or inhibits glaucoma and/or elevated IOP is a beta blocker. In some embodiments, the agent that treats or inhibits glaucoma and/or elevated IOP is an alpha-adrenergic agonist. In some embodiments, the agent that treats or inhibits glaucoma and/or elevated IOP is a carbonic anhydrase inhibitor. In some embodiments, the agent that treats or inhibits glaucoma and/or elevated IOP is a rho kinase inhibitor. In some embodiments, the agent that treats or inhibits glaucoma and/or elevated IOP is a miotic or cholinergic agent.

In some embodiments, the prostaglandin is latanopros, travoprost, tafluprost, bimatoprost, or latanoprostene bunod. In some embodiments, the prostaglandin is latanopros. In some embodiments, the prostaglandin is travopros. In some embodiments, the prostaglandin is tafluprost. In some embodiments, the prostaglandin is bimatoprost. In some embodiments, the prostaglandin is latanoprostene bunod. In some embodiments, the prostaglandin is XALATAN® (latanoprost), TRAVATAN Z® (travopros), ZIOPTAN® (tafluprost), LUMIGAN® (bimatoprost), or VYZULTA® (latanoprostene bunod). In some embodiments, the prostaglandin is XALATAN® (latanoprost). In some embodiments, the prostaglandin is TRAVATAN Z® (travoprost). In some embodiments, the prostaglandin is ZIOPTAN® (tafluprost). In some embodiments, the prostaglandin is LUMIGAN® (bimatoprost). In some embodiments, the prostaglandin is VYZULTA® (latanoprostene bunod).

In some embodiments, the beta blocker is timolol or betaxolol. In some embodiments, the beta blocker is timolol. In some embodiments, the beta blocker is betaxolol. In some embodiments, the beta blocker is BETIMOL®, ISTALOL®, or TIMOPTIC® (timolol) or BETOPTIC® (betaxolol). In some embodiments, the beta blocker is BETIMOL® (timolol). In some embodiments, the beta blocker is ISTALOL® (timolol). In some embodiments, the beta blocker is TIMOPTIC® (timolol). In some embodiments, the beta blocker is BETOPTIC® (betaxolol).

In some embodiments, the alpha-adrenergic agonist is apraclonidine or brimonidine. In some embodiments, the alpha-adrenergic agonist is apraclonidine. In some embodiments, the alpha-adrenergic agonist is brimonidine. In some embodiments, the alpha-adrenergic agonist is IOPIDINE® (apraclonidine) or ALPHAGAN® or QOLIANA® (brimonidine). In some embodiments, the alpha-adrenergic agonist is IOPIDINE® (apraclonidine). In some embodiments, the alpha-adrenergic agonist is ALPHAGAN® (brimonidine). In some embodiments, the alpha-adrenergic agonist is QOLIANA® (brimonidine).

In some embodiments, the carbonic anhydrase inhibitor is dorzolamide or brinzolamide. In some embodiments, the carbonic anhydrase inhibitor is dorzolamide. In some embodiments, the carbonic anhydrase inhibitor is brinzolamide. In some embodiments, the carbonic anhydrase inhibitor is TRUSOPT® (dorzolamide) or AZOPT® (brinzolamide). In some embodiments, the carbonic anhydrase inhibitor is TRUSOPT® (dorzolamide). In some embodiments, the carbonic anhydrase inhibitor is AZOPT® (brinzolamide).

In some embodiments, the rho kinase inhibitor is netarsudil. In some embodiments, the rho kinase inhibitor is RHOPRESSA® (netarsudil).

In some embodiments, the miotic or cholinergic agent is pilocarpine. In some embodiments, the miotic or cholinergic agent is ISOPTO® Carpine (pilocarpine).

In some embodiments, the dose of the therapeutic agents that treat or inhibit glaucoma and/or elevated IOP can be reduced by about 10%, by about 20%, by about 30%, by about 40%, by about 50%, by about 60%, by about 70%, by about 80%, or by about 90% for subjects that are heterozygous for an ARHGEF12 predicted loss-of-function variant (i.e., a lower than the standard dosage amount) compared to subjects that are ARHGEF12 reference (who may receive a standard dosage amount). In some embodiments, the dose of the therapeutic agents that treat or inhibit glaucoma and/or elevated IOP can be reduced by about 10%, by about 20%, by about 30%, by about 40%, or by about 50%. In addition, the dose of therapeutic agents that treat or inhibit glaucoma and/or elevated IOP in subjects that are heterozygous for an ARHGEF12 predicted loss-of-function variant can be administered less frequently compared to subjects that are ARHGEF12 reference.

In some embodiments, the dose of the therapeutic agents that treat or inhibit glaucoma and/or elevated IOP can be increased by about 10%, by about 20%, by about 30%, by about 40%, by about 50%, by about 60%, by about 70%, by about 80%, or by about 90% for subjects that are heterozygous for an ARHGEF12 predicted gain-of-function variant (i.e., a higher than the standard dosage amount) compared to subjects that are ARHGEF12 reference (who may receive a standard dosage amount). In some embodiments, the dose of the therapeutic agents that treat or inhibit glaucoma and/or elevated IOP can be increased by about 10%, by about 20%, by about 30%, by about 40%, or by about 50%. In addition, the dose of therapeutic agents that treat or inhibit glaucoma and/or elevated IOP in subjects that are heterozygous for an ARHGEF12 predicted gain-of-function variant can be administered more frequently compared to subjects that are ARHGEF12 reference.

Administration of the therapeutic agents that treat or inhibit glaucoma and/or elevated IOP, and/or ARHGEF12 inhibitors, can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a subject can receive therapy for a prolonged period of time such as, for example, 6 months, 1 year, or more.

Administration of the therapeutic agents that treat or inhibit glaucoma and/or elevated IOP, and/or ARHGEF12 inhibitors, can occur by any suitable route including, but not limited to, parenteral, intravenous, oral, subcutaneous, intraarterial, intracranial, intrathecal, intraperitoneal, topical, intranasal, or intramuscular. Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

The terms "treat", "treating", and "treatment" and "prevent", "preventing", and "prevention" as used herein, refer to eliciting the desired biological response, such as a therapeutic and prophylactic effect, respectively. In some embodiments, a therapeutic effect comprises one or more of a decrease/reduction in glaucoma and/or elevated IOP, a decrease/reduction in the severity of glaucoma and/or elevated IOP (such as, for example, a reduction or inhibition of development or glaucoma and/or elevated IOP), a decrease/reduction in symptoms of glaucoma and elevated IOP-related effects, delaying the onset of symptoms of glaucoma and elevated IOP-related effects, reducing the severity of symptoms of glaucoma and elevated IOP-related effects, reducing the severity of an acute episode, reducing the number of symptoms of glaucoma and elevated IOP-related effects, reducing the latency of symptoms of glaucoma and elevated IOP-related effects, an amelioration of symptoms of glaucoma and elevated IOP-related effects, reducing secondary symptoms, reducing secondary infections, preventing relapse to glaucoma and/or elevated IOP, decreasing the number or frequency of relapse episodes, increasing latency between symptomatic episodes, increasing time to sustained progression, speeding recovery, and/or increasing efficacy of or decreasing resistance to alternative therapeutics, following administration of the agent or composition comprising the agent. A prophylactic effect may comprise a complete or partial avoidance/inhibition or a delay of glaucoma and/or elevated IOP development/progression (such as, for example, a complete or partial avoidance/inhibition or a delay) following administration of a therapeutic protocol. Treatment of glaucoma and/or elevated IOP encompasses the treatment of subjects already diagnosed as having any form of glaucoma at any clinical stage or manifestation and/or elevated IOP, the delay of the onset or evolution or aggravation or deterioration of the symptoms or signs of glaucoma and/or elevated IOP, and/or preventing and/or reducing the severity of glaucoma and/or elevated IOP.

The present disclosure also provides methods of identifying a subject having an increased risk for developing glaucoma and/or elevated IOP. In some embodiments, the methods comprise determining or having determined in a biological sample obtained from the subject the presence or absence of an ARHGEF12 predicted loss-of-function variant nucleic acid molecule (such as a genomic nucleic acid molecule, mRNA molecule, and/or cDNA molecule) encoding a human ARHGEF12 polypeptide. When the subject lacks an ARHGEF12 predicted loss-of-function variant nucleic acid molecule (such as, for example, the subject is genotypically categorized as an ARHGEF12 reference), then the subject has an increased risk for developing glaucoma and/or elevated IOP. When the subject has an ARHGEF12 predicted loss-of-function variant nucleic acid molecule (such as, for example, the subject is heterozygous or homozygous for an ARHGEF12 predicted loss-of-function variant), then the subject has a decreased risk for developing glaucoma and/or elevated IOP.

Having a single copy of an ARHGEF12 predicted loss-of-function variant nucleic acid molecule is more protective of a subject from developing glaucoma and/or elevated IOP than having no copies of an ARHGEF12 predicted loss-of-function variant nucleic acid molecule. Without intending to be limited to any particular theory or mechanism of action, it is believed that a single copy of an ARHGEF12 predicted loss-of-function variant nucleic acid molecule (i.e., heterozygous for an ARHGEF12 predicted loss-of-function variant) is protective of a subject from developing glaucoma and/or elevated IOP, and it is also believed that having two copies of an ARHGEF12 predicted loss-of-function variant nucleic acid molecule (i.e., homozygous for an ARHGEF12 predicted loss-of-function variant) may be more protective of a subject from developing glaucoma and/or elevated IOP, relative to a subject with a single copy. Thus, in some embodiments, a single copy of an ARHGEF12 predicted loss-of-function variant nucleic acid molecule may not be completely protective, but instead, may be partially or incompletely protective of a subject from developing glaucoma and/or elevated IOP. While not desiring to be bound by any particular theory, there may be additional factors or molecules involved in the development of glaucoma and/or elevated IOP that are still present in a subject having a single copy of an ARHGEF12 predicted loss-of-function variant nucleic acid molecule, thus resulting in less than complete protection from the development of glaucoma and/or elevated IOP.

In some embodiments, the method comprises determining or having determined in a biological sample obtained from the subject the presence or absence of an ARHGEF12 predicted gain-of-function variant nucleic acid molecule (such as a genomic nucleic acid molecule, mRNA molecule, and/or cDNA molecule) encoding a human ARHGEF12 polypeptide. When the subject lacks an ARHGEF12 predicted gain-of-function variant nucleic acid molecule (such as, for example, the subject is genotypically categorized as an ARHGEF12 reference), then the subject has a decreased risk for developing glaucoma and/or elevated IOP. When the subject has an ARHGEF12 predicted gain-of-function variant nucleic acid molecule (i.e., the subject is heterozygous or homozygous for an ARHGEF12 predicted gain-of-function variant), then the subject has an increased risk for developing glaucoma and/or elevated IOP.

Having a single copy of an ARHGEF12 predicted gain-of-function variant nucleic acid molecule is a greater risk of a subject for developing glaucoma and/or elevated IOP than having no copies of an ARHGEF12 predicted gain-of-function variant nucleic acid molecule. Without intending to be limited to any particular theory or mechanism of action, it is believed that a single copy of an ARHGEF12 predicted gain-of-function variant nucleic acid molecule (i.e., heterozygous for an ARHGEF12 predicted gain-of-function variant) increases the risk of a subject for developing glaucoma and/or elevated IOP, and it is also believed that having two copies of an ARHGEF12 predicted gain-of-function variant nucleic acid molecule (i.e., homozygous for an ARHGEF12 predicted loss-of-function variant) further increase the risk of a subject for developing glaucoma and/or elevated IOP, relative to a subject with a single copy. Thus, in some embodiments, a single copy of an ARHGEF12 predicted gain-of-function variant nucleic acid molecule may be a partial or incomplete risk for a subject for developing glaucoma and/or elevated IOP. While not desiring to be bound by any particular theory, there may be additional factors or molecules involved in the development of glaucoma and/or elevated IOP that are still present in a subject having a single copy of an ARHGEF12 predicted gain-of-function variant nucleic acid molecule, thus resulting in an increased risk of a subject for developing glaucoma and/or elevated IOP.

Determining whether a subject has an ARHGEF12 predicted loss-of-function variant nucleic acid molecule or an ARHGEF12 predicted gain-of-function variant nucleic acid molecule in a biological sample from a subject and/or determining whether a subject has an ARHGEF12 predicted loss-of-function variant nucleic acid molecule or an ARHGEF12 predicted gain-of-function variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, when a subject is identified as having an increased risk of developing glaucoma and/or elevated IOP, the subject is further treated with a therapeutic agent that treats or inhibits glaucoma and/or elevated IOP, and/or an ARHGEF12 inhibitor, as described herein. For example, when the subject is ARHGEF12 reference, and therefore has an increased risk for developing glaucoma and/or elevated IOP, the subject is administered an ARHGEF12 inhibitor. In some embodiments, such a subject is also administered a therapeutic agent that treats or inhibits glaucoma and/or elevated IOP. In some embodiments, when the subject is heterozygous for an ARHGEF12 predicted loss-of-function variant, the subject is administered the therapeutic agent that treats or inhibits glaucoma and/or elevated IOP in a dosage amount that is the same as or lower than a standard dosage amount, and can also be administered an ARHGEF12 inhibitor. In some embodiments, when the subject is heterozygous for an ARHGEF12 predicted gain-of-function variant, the subject is administered the therapeutic agent that treats or inhibits glaucoma and/or elevated IOP in a dosage amount that is the same as or greater than a standard dosage amount, and can also be administered an ARHGEF12 inhibitor. In some embodiments, the subject is ARHGEF12 reference. In some embodiments, the subject is heterozygous for an ARHGEF12 predicted loss-of-function variant.

The present disclosure also provides methods of detecting the presence or absence of an ARHGEF12 predicted loss-of-function variant genomic nucleic acid molecule, and/or an ARHGEF12 predicted gain-of-function variant genomic nucleic acid molecule in a biological sample from a subject, and/or an ARHGEF12 predicted loss-of-function variant mRNA molecule in a biological sample from a subject and/or an ARHGEF12 predicted gain-of-function variant mRNA in a biological sample from a subject, and/or an ARHGEF12 predicted loss-of-function variant cDNA molecule and/or an ARHGEF12 predicted gain-of-function variant cDNA molecule produced from an mRNA molecule in a biological sample from a subject. It is understood that gene sequences within a population and mRNA molecules encoded by such genes can vary due to polymorphisms such as single-nucleotide polymorphisms. The sequences provided herein for the ARHGEF12 variant genomic nucleic acid molecule, ARHGEF12 variant mRNA molecule, and ARHGEF12 variant cDNA molecule are only exemplary sequences. Other sequences for the ARHGEF12 variant genomic nucleic acid molecule, variant mRNA molecule, and variant cDNA molecule are also possible.

The biological sample can be derived from any cell, tissue, or biological fluid from the subject. The biological sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The biological sample used in the methods disclosed herein can vary based on the assay format, nature of the detection method, and the tissues, cells, or extracts that are used as the sample. A biological sample can be processed differently depending on the assay being employed. For example, when detecting any ARHGEF12 variant nucleic acid molecule, preliminary processing designed to isolate or enrich the biological sample for the genomic DNA can be employed. A variety of techniques may be used for this purpose. When detecting the level of any ARHGEF12 variant mRNA molecule, different techniques can be used enrich the biological sample with mRNA molecules. Various methods to detect the presence or level of an mRNA molecule or the presence of a particular variant genomic DNA locus can be used.

In some embodiments, detecting a human ARHGEF12 predicted loss-of-function variant nucleic acid molecule in a subject comprises assaying or genotyping a biological sample obtained from the subject to determine whether an ARHGEF12 genomic nucleic acid molecule in the biological sample, and/or an ARHGEF12 mRNA molecule in the biological sample, and/or an ARHGEF12 cDNA molecule produced from an mRNA molecule in the biological sample, comprises one or more variations that cause a loss-of-function (partial or complete) or are predicted to cause a loss-of-function (partial or complete).

In some embodiments, detecting a human ARHGEF12 predicted gain-of-function variant nucleic acid molecule in a subject comprises assaying or genotyping a biological sample obtained from the subject to determine whether an ARHGEF12 genomic nucleic acid molecule in the biological sample, and/or an ARHGEF12 mRNA molecule in the biological sample, and/or an ARHGEF12 cDNA molecule produced from an mRNA molecule in the biological sample, comprises one or more variations that cause a gain-of-function or are predicted to cause a gain-of-function.

In some embodiments, the methods of detecting the presence or absence of an ARHGEF12 predicted loss-of-function variant nucleic acid molecule or an ARHGEF12 predicted gain-of-function variant nucleic acid molecule (such as, for example, a genomic nucleic acid molecule, an mRNA molecule, and/or a cDNA molecule produced from an mRNA molecule) in a subject, comprise performing an assay on a biological sample obtained from the subject. The assay determines whether a nucleic acid molecule in the biological sample comprises a particular nucleotide sequence.

In some embodiments, the nucleotide sequence encoding an ARHGEF12 predicted gain-of-function variant comprises: a thymine at a position corresponding to position 132,939 according to SEQ ID NO:2 (for genomic nucleic acid molecules); a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23 (for mRNA molecules); a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54 (for cDNA molecules).

In some embodiments, the nucleotide sequence encoding an ARHGEF12 predicted loss-of-function variant comprises: a guanine at a position corresponding to position 143,698 according to SEQ ID NO:3 (for genomic nucleic acid molecules); a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61 (for cDNA molecules).

In some embodiments, the nucleotide sequence encoding an ARHGEF12 predicted loss-of-function variant comprises: a thymine at a position corresponding to position 141,048 according to SEQ ID NO:4 (for genomic nucleic acid molecules); a uracil at a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38 (for mRNA molecules); a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69 (for cDNA molecules).

In some embodiments, the nucleotide sequence encoding an ARHGEF12 predicted loss-of-function variant comprises an adenine at a position corresponding to position 73,039 according to SEQ ID NO:5 (for genomic nucleic acid molecules).

In some embodiments, the nucleotide sequence encoding an ARHGEF12 predicted loss-of-function variant comprises a cytosine at a position corresponding to position 121,307 according to SEQ ID NO:6 (for genomic nucleic acid molecules).

In some embodiments, the nucleotide sequence encoding an ARHGEF12 predicted loss-of-function variant comprises a cytosine at a position corresponding to position 141,978 according to SEQ ID NO:7 (for genomic nucleic acid molecules).

In some embodiments, the nucleotide sequence comprises: a thymine at a position corresponding to position 132,939 according to SEQ ID NO:2 or the complement thereof, a guanine at a position corresponding to position 143,698 according to SEQ ID NO:3 or the complement thereof, a thymine at a position corresponding to position 141,048 according to SEQ ID NO:4 or the complement thereof, an adenine at a position corresponding to position 73,039 according to SEQ ID NO:5 or the complement thereof, a cytosine at a position corresponding to position 121,307 according to SEQ ID NO:6 or the complement thereof, or a cytosine at a position corresponding to position 141,978 according to SEQ ID NO:7 or the complement thereof.

In some embodiments, the nucleotide sequence of the ARHGEF12 variant mRNA molecule comprises: i) a uracil at a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, or position 2,615 according to SEQ ID NO:23 or the complement thereof; ii) a guanine at a position corresponding to: position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, or position 3,614 according to SEQ ID NO:30 or the complement thereof; or iii) a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof.

In some embodiments, the nucleotide sequence of the ARHGEF12 variant cDNA molecule comprises: i) a thymine at a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54 or the complement thereof; ii) a guanine at a position corresponding to: position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, position 3,614 according to SEQ ID NO:61 or the complement thereof; or iii) a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof.

In some embodiments, the biological sample comprises a cell or cell lysate. Such methods can further comprise, for example, obtaining a biological sample from the subject comprising an ARHGEF12 genomic nucleic acid molecule or mRNA molecule, and if mRNA, optionally reverse transcribing the mRNA into cDNA. Such assays can comprise, for example determining the identity of these positions of the particular ARHGEF12 nucleic acid molecule. In some embodiments, the method is an in vitro method.

In some embodiments, the determining step, detecting step, or genotyping assay comprises sequencing at least a portion of the nucleotide sequence of the ARHGEF12 genomic nucleic acid molecule, the ARHGEF12 mRNA molecule, or the ARHGEF12 cDNA molecule in the biological sample, wherein the sequenced portion comprises one or more variations that cause a loss-of-function (partial or complete) or are predicted to cause a loss-of-function (partial or complete) or that cause a gain-of-function (partial or complete) or are predicted to cause a gain-of-function (partial or complete).

In some embodiments, the determining step, detecting step, or genotyping assay comprises sequencing at least a portion of: i) the nucleotide sequence of the ARHGEF12 genomic nucleic acid molecule in the biological sample, wherein the sequenced portion comprises a position corresponding to position 132,939 according to SEQ ID NO:2, or the complement thereof; ii) the nucleotide sequence of the ARHGEF12 mRNA molecule in the biological sample, wherein the sequenced portion comprises a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, or position 2,615 according to SEQ ID NO:23 or the complement thereof; and/or iii) the nucleotide sequence of the ARHGEF12 cDNA molecule produced from the mRNA in the biological sample, wherein the sequenced portion comprises a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54 or the complement thereof. When the sequenced portion of the ARHGEF12 nucleic acid molecule in the biological sample comprises: i) a thymine at a position corresponding to position 132,939 according to SEQ ID NO:2; ii) a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23; or iii) a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54, then the ARHGEF12 nucleic acid molecule in the biological sample is an ARHGEF12 predicted gain-of-function variant nucleic acid molecule.

In some embodiments, the determining step, detecting step, or genotyping assay comprises sequencing at least a portion of: i) the nucleotide sequence of the ARHGEF12 genomic nucleic acid molecule in the biological sample, wherein the sequenced portion comprises a position corresponding to position 143,698 according to SEQ ID NO:3, or the complement thereof; ii) the nucleotide sequence of the ARHGEF12 mRNA molecule in the biological sample, wherein the sequenced portion comprises a position corresponding to: position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, or position 3,614 according to SEQ ID NO:30 or the complement thereof; and/or iii) the nucleotide sequence of the ARHGEF12 cDNA molecule produced from the mRNA in the biological sample, wherein the sequenced portion comprises a position corresponding to: position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, or position 3,614 according to SEQ ID NO:61 or the complement thereof. When the sequenced portion of the ARHGEF12 nucleic acid molecule in the biological sample comprises: i) a guanine at a position corresponding to position 143,698 according to SEQ ID NO:3; ii) a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; or iii) a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61, then the ARHGEF12 nucleic acid molecule in the biological sample is an ARHGEF12 predicted loss-of-function variant nucleic acid molecule.

In some embodiments, the determining step, detecting step, or genotyping assay comprises sequencing at least a portion of: i) the nucleotide sequence of the ARHGEF12 genomic nucleic acid molecule in the biological sample, wherein the sequenced portion comprises a position corresponding to position 141,048 according to SEQ ID NO:4, or the complement thereof; ii) the nucleotide sequence of the ARHGEF12 mRNA molecule in the biological sample, wherein the sequenced portion comprises a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; and/or iii) the nucleotide sequence of the ARHGEF12 cDNA molecule produced from the mRNA in the biological sample, wherein the sequenced portion comprises a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof. When the sequenced portion of the ARHGEF12 nucleic acid molecule in the biological sample comprises: i) a thymine at a position corresponding to position 141,048 according to SEQ ID NO:4; ii) a uracil at a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38; or iii) a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69, then the ARHGEF12 nucleic acid molecule in the biological sample is an ARHGEF12 predicted loss-of-function variant nucleic acid molecule.

In some embodiments, the determining step, detecting step, or genotyping assay comprises sequencing at least a portion of the nucleotide sequence of the ARHGEF12 genomic nucleic acid molecule in the biological sample, wherein the sequenced portion comprises a position corresponding to position 73,039 according to SEQ ID NO:5, or the complement thereof. When the sequenced portion of the ARHGEF12 nucleic acid molecule in the biological sample comprises an adenine at a position corresponding to position 73,039 according to SEQ ID NO:5, then the ARHGEF12 nucleic acid molecule in the biological sample is an ARHGEF12 predicted loss-of-function variant nucleic acid molecule.

In some embodiments, the determining step, detecting step, or genotyping assay comprises sequencing at least a portion of the nucleotide sequence of the ARHGEF12 genomic nucleic acid molecule in the biological sample, wherein the sequenced portion comprises a position corresponding to position 121,307 according to SEQ ID NO:6, or the complement thereof. When the sequenced portion of the ARHGEF12 nucleic acid molecule in the biological sample comprises a cytosine at a position corresponding to position 121,307 according to SEQ ID NO:6, then the ARHGEF12 nucleic acid molecule in the biological sample is an ARHGEF12 predicted loss-of-function variant nucleic acid molecule.

In some embodiments, the determining step, detecting step, or genotyping assay comprises sequencing at least a portion of the nucleotide sequence of the ARHGEF12 genomic nucleic acid molecule in the biological sample, wherein the sequenced portion comprises a position corresponding to position 141,978 according to SEQ ID NO:7, or the complement thereof. When the sequenced portion of the ARHGEF12 nucleic acid molecule in the biological sample comprises a cytosine at a position corresponding to position 141,978 according to SEQ ID NO:7, then the ARHGEF12 nucleic acid molecule in the biological sample is an ARHGEF12 predicted loss-of-function variant nucleic acid molecule.

In some embodiments, the determining step, detecting step, or genotyping assay comprises sequencing at least a portion of the nucleotide sequence of the ARHGEF12 genomic nucleic acid molecule in the biological sample, wherein the sequenced portion comprises a position corresponding to: position 132,939 according to SEQ ID NO:2 or the complement thereof, position 143,698 according to SEQ ID NO:3 or the complement thereof, position 141,048 according to SEQ ID NO:4 or the complement thereof, position 73,039 according to SEQ ID NO:5 or the complement thereof, position 121,307 according to SEQ ID NO:6 or the complement thereof, or position 141,978 according to SEQ ID NO:7 or the complement. When the sequenced portion of the ARHGEF12 nucleic acid molecule in the biological sample comprises a thymine at a position corresponding to position 132,939 according to SEQ ID NO:2, then the ARHGEF12 nucleic acid molecule in the biological sample is an ARHGEF12 predicted gain-of-function variant nucleic acid molecule. When the sequenced portion of the ARHGEF12 nucleic acid molecule in the biological sample comprises: a guanine at a position corresponding to position 143,698 according to SEQ ID NO:3, a thymine at a position corresponding to position 141,048 according to SEQ ID NO:4, an adenine at a position corresponding to position 73,039 according to SEQ ID NO:5, a cytosine at a position corresponding to position 121,307 according to SEQ ID NO:6, or a cytosine at a position corresponding to position 141,978 according to SEQ ID NO:7, then the ARHGEF12 nucleic acid molecule in the biological sample is an ARHGEF12 predicted loss-of-function variant nucleic acid molecule.

In some embodiments, the determining step, detecting step, or genotyping assay comprises sequencing at least a portion of the nucleotide sequence of the ARHGEF12 mRNA molecule in the biological sample, wherein the sequenced portion comprises a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, position 2,615 according to SEQ ID NO:23 or the complement thereof, position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, position 3,614 according to SEQ ID NO:30 or the complement thereof, position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof. When the sequenced portion of the ARHGEF12 nucleic acid molecule in the biological sample comprises a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, position 2,615 according to SEQ ID NO:23, then the ARHGEF12 nucleic acid molecule in the biological sample is an ARHGEF12 predicted gain-of-function variant nucleic acid molecule. When the sequenced portion of the ARHGEF12 nucleic acid molecule in the biological sample comprises a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, position 3,614 according to SEQ ID NO:30, or position 4,297 according to SEQ ID NO:31; or comprises a uracil at a position corresponding to: position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38, then the ARHGEF12 nucleic acid molecule in the biological sample is an ARHGEF12 predicted loss-of-function variant nucleic acid molecule.

In some embodiments, the determining step, detecting step, or genotyping assay comprises sequencing at least a portion of the nucleotide sequence of the ARHGEF12 cDNA molecule produced from the mRNA molecule in the biological sample, wherein the sequenced portion comprises a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, position 2,615 according to SEQ ID NO:54 or the complement thereof position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, position 3,614 according to SEQ ID NO:61 or the complement thereof, position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof. When the sequenced portion of the ARHGEF12 nucleic acid molecule in the biological sample comprises a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54, then the ARHGEF12 nucleic acid molecule in the biological sample is an ARHGEF12 predicted gain-of-function variant nucleic acid molecule. When the sequenced portion of the ARHGEF12 nucleic acid molecule in the biological sample comprises a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61; or a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69, then the ARHGEF12 nucleic acid molecule in the biological sample is an ARHGEF12 predicted loss-of-function variant nucleic acid molecule.

In some embodiments, the determining step, detecting step, or genotyping assay comprises: a) contacting the biological sample with a primer hybridizing to a portion of the nucleotide sequence of the ARHGEF12: i) genomic nucleic acid molecule that is proximate to a position corresponding to position 132,939 according to SEQ ID NO:2; ii) mRNA molecule that is proximate to a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23; and/or iii) cDNA molecule that is proximate to a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54; b) extending the primer at least through the position of the nucleotide sequence of the ARHGEF12: i) genomic nucleic acid molecule corresponding to position 132,939 according to SEQ ID NO:2; ii) mRNA molecule corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, or position 3,054 according to SEQ ID NO:22; and/or iii) cDNA molecule corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54; and c) determining whether the extension product of the primer comprises: i) a thymine at a position corresponding to position 132,939 according to SEQ ID NO:2; ii) a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23; or iii) a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54.

In some embodiments, the determining step, detecting step, or genotyping assay comprises: a) contacting the biological sample with a primer hybridizing to a portion of the nucleotide sequence of the ARHGEF12: i) genomic nucleic acid molecule that is proximate to a position corresponding to position 143,698 according to SEQ ID NO:3; ii) mRNA molecule that is proximate to a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; and/or iii) cDNA molecule that is proximate to a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61; b) extending the primer at least through the position of the nucleotide sequence of the ARHGEF12: i) genomic nucleic acid molecule corresponding to position 143,698 according to SEQ ID NO:3; ii) mRNA molecule corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; and/or iii) cDNA molecule corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61; and c) determining whether the extension product of the primer comprises: i) a guanine at a position corresponding to position 143,698 according to SEQ ID NO:3; ii) a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; or iii) a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61.

In some embodiments, the determining step, detecting step, or genotyping assay comprises: a) contacting the biological sample with a primer hybridizing to a portion of the nucleotide sequence of the ARHGEF12: i) genomic nucleic acid molecule that is proximate to a position corresponding to position 141,048 according to SEQ ID NO:4; ii) mRNA molecule that is proximate to a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38; and/or iii) cDNA molecule that is proximate to a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69; b) extending the primer at least through the position of the nucleotide sequence of the ARHGEF12: i) genomic nucleic acid molecule corresponding to position 141,048 according to SEQ ID NO:4; ii) mRNA molecule corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38; and/or iii) cDNA molecule corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69; and c) determining whether the extension product of the primer comprises: i) a thymine at a position corresponding to position 141,048 according to SEQ ID NO:4; ii) a uracil at a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38; or iii) a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69.

In some embodiments, the determining step, detecting step, or genotyping assay comprises: a) contacting the biological sample with a primer hybridizing to a portion of the nucleotide sequence of the ARHGEF12 genomic nucleic acid molecule that is proximate to a position corresponding to position 73,039 according to SEQ ID NO:5; b) extending the primer at least through the position of the nucleotide sequence of the ARHGEF12 genomic nucleic acid molecule corresponding to position 73,039 according to SEQ ID NO:5; and c) determining whether the extension product of the primer comprises an adenine at a position corresponding to position 73,039 according to SEQ ID NO:5.

In some embodiments, the determining step, detecting step, or genotyping assay comprises: a) contacting the biological sample with a primer hybridizing to a portion of the nucleotide sequence of the ARHGEF12 genomic nucleic acid molecule that is proximate to a position corresponding to position 121,307 according to SEQ ID NO:6; b) extending the primer at least through the position of the nucleotide sequence of the ARHGEF12 genomic nucleic acid molecule corresponding to position 121,307 according to SEQ ID NO:6; and c) determining whether the extension product of the primer comprises a cytosine at a position corresponding to position 121,307 according to SEQ ID NO:6.

In some embodiments, the determining step, detecting step, or genotyping assay comprises: a) contacting the biological sample with a primer hybridizing to a portion of the nucleotide sequence of the ARHGEF12 genomic nucleic acid molecule that is proximate to a position corresponding to position 141,978 according to SEQ ID NO:7; b) extending the primer at least through the position of the nucleotide sequence of the ARHGEF12 genomic nucleic acid molecule corresponding to position 141,978 according to SEQ ID NO:7; and c) determining whether the extension product of the primer comprises a cytosine at a position corresponding to position 141,978 according to SEQ ID NO:7.

In some embodiments, the determining step, detecting step, or genotyping assay comprises: a) contacting the biological sample with a primer hybridizing to a portion of the nucleotide sequence of the ARHGEF12 genomic nucleic acid molecule that is proximate to a position corresponding to: position 132,939 according to SEQ ID NO:2, position 143,698 according to SEQ ID NO:3, position 141,048 according to SEQ ID NO:4, position 73,039 according to SEQ ID NO:5, position 121,307 according to SEQ ID NO:6, or position 141,978 according to SEQ ID NO:7; b) extending the primer at least through the position of the nucleotide sequence of the ARHGEF12 genomic nucleic acid molecule corresponding to: position 132,939 according to SEQ ID NO:2, position 143,698 according to SEQ ID NO:3, position 141,048 according to SEQ ID NO:4, position 73,039 according to SEQ ID NO:5, position 121,307 according to SEQ ID NO:6, or position 141,978 according to SEQ ID NO:7; and c) determining whether the extension product of the primer comprises: a thymine at a position corresponding to position 132,939 according to SEQ ID NO:2, a guanine at a position corresponding to position 143,698 according to SEQ ID NO:3, a thymine at a position corresponding to position 141,048 according to SEQ ID NO:4, an adenine at a position corresponding to position 73,039 according to SEQ ID NO:5, a cytosine at a position corresponding to position 121,307 according to SEQ ID NO:6, or a cytosine at a position corresponding to position 141,978 according to SEQ ID NO:7.

In some embodiments, the determining step, detecting step, or genotyping assay comprises: a) contacting the biological sample with a primer hybridizing to a portion of the nucleotide sequence of the ARHGEF12 mRNA molecule that is proximate to a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, position 2,615 according to SEQ ID NO:23, position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, position 3,614 according to SEQ ID NO:30, position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38; b) extending the primer at least through the position of the nucleotide sequence of the ARHGEF12 mRNA molecule corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, position 2,615 according to SEQ ID NO:23, position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, position 3,614 according to SEQ ID NO:30, position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38, and c) determining whether the extension product of the primer comprises: i) a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23; ii) a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; or iii) a uracil at a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38.

In some embodiments, the determining step, detecting step, or genotyping assay comprises: a) contacting the biological sample with a primer hybridizing to a portion of the nucleotide sequence of the ARHGEF12 cDNA molecule that is proximate to a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, position 2,615 according to SEQ ID NO:54, position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, position 3,614 according to SEQ ID NO:61, position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69; b) extending the primer at least through the position of the nucleotide sequence of the ARHGEF12 cDNA molecule corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, position 2,615 according to SEQ ID NO:54, position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, position 3,614 according to SEQ ID NO:61, position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69; and c) determining whether the extension product of the primer comprises: i) a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54; ii) a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61; or iii) a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69.

In some embodiments, the assay comprises sequencing the entire nucleic acid molecule. In some embodiments, only an ARHGEF12 genomic nucleic acid molecule is analyzed. In some embodiments, only an ARHGEF12 mRNA is analyzed. In some embodiments, only an ARHGEF12 cDNA obtained from ARHGEF12 mRNA is analyzed.

In some embodiments, the determining step, detecting step, or genotyping assay comprises: a) amplifying at least a portion of the nucleic acid molecule that encodes the human ARHGEF12 polypeptide, wherein the amplified portion comprises: i) a thymine at a position corresponding to position 132,939 according to SEQ ID NO:2, or the complement thereof; ii) a uracil at a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, or position 2,615 according to SEQ ID NO:23 or the complement thereof; and/or iii) a thymine at a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54 or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) a thymine at a position corresponding to position 132,939 according to SEQ ID NO:2, or the complement thereof; ii) a uracil at a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, or position 2,615 according to SEQ ID NO:23 or the complement thereof; and/or iii) a thymine at a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54 or the complement thereof; and d) detecting the detectable label.

In some embodiments, the determining step, detecting step, or genotyping assay comprises: a) amplifying at least a portion of the nucleic acid molecule that encodes the human ARHGEF12 polypeptide, wherein the amplified portion comprises: i) a guanine at a position corresponding to position 143,698 according to SEQ ID NO:3 or the complement thereof; ii) a guanine at a position corresponding to: position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, or position 3,614 according to SEQ ID NO:30 or the complement thereof; and/or iii) a guanine at a position corresponding to: position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, or position 3,614 according to SEQ ID NO:61 or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) a guanine at a position corresponding to position 143,698 according to SEQ ID NO:3 or the complement thereof; ii) a guanine at a position corresponding to: position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, or position 3,614 according to SEQ ID NO:30 or the complement thereof; and/or iii) a guanine at a position corresponding to: position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, or position 3,614 according to SEQ ID NO:61 or the complement thereof; and d) detecting the detectable label.

In some embodiments, the determining step, detecting step, or genotyping assay comprises: a) amplifying at least a portion of the nucleic acid molecule that encodes the human ARHGEF12 polypeptide, wherein the amplified portion comprises: i) a thymine at a position corresponding to position 141,048 according to SEQ ID NO:4 or the complement thereof; ii) a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; and/or iii) a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) a thymine at a position corresponding to position 141,048 according to SEQ ID NO:4 or the complement thereof; ii) a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; and/or iii) a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof; and d) detecting the detectable label.

In some embodiments, the determining step, detecting step, or genotyping assay comprises: a) amplifying at least a portion of the nucleic acid molecule that encodes the human ARHGEF12 polypeptide, wherein the amplified portion comprises an adenine at a position corresponding to position 73,039 according to SEQ ID NO:5, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising an adenine at a position corresponding to position 73,039 according to SEQ ID NO:5, or the complement thereof; and d) detecting the detectable label.

In some embodiments, the determining step, detecting step, or genotyping assay comprises: a) amplifying at least a portion of the nucleic acid molecule that encodes the human ARHGEF12 polypeptide, wherein the amplified portion comprises a cytosine at a position corresponding to position 121,307 according to SEQ ID NO:6, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising a cytosine at a position corresponding to position 121,307 according to SEQ ID NO:6, or the complement thereof; and d) detecting the detectable label.

In some embodiments, the determining step, detecting step, or genotyping assay comprises: a) amplifying at least a portion of the nucleic acid molecule that encodes the human ARHGEF12 polypeptide, wherein the amplified portion comprises: a cytosine at a position corresponding to position 141,978 according to SEQ ID NO:7, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising a cytosine at a position corresponding to position 141,978 according to SEQ ID NO:7, or the complement thereof; and d) detecting the detectable label.

In some embodiments, the determining step, detecting step, or genotyping assay comprises: a) amplifying at least a portion of the genomic nucleic acid molecule that encodes the human ARHGEF12 polypeptide, wherein the amplified portion comprises: a thymine at a position corresponding to position 132,939 according to SEQ ID NO:2, or the complement thereof; a guanine at a position corresponding to position 143,698 according to SEQ ID NO:3, or the complement thereof; a thymine at a position corresponding to position 141,048 according to SEQ ID NO:4, or the complement thereof; an adenine at a position corresponding to position 73,039 according to SEQ ID NO:5, or the complement thereof; a cytosine at a position corresponding to position 121,307 according to SEQ ID NO:6, or the complement thereof; or a cytosine at a position corresponding to position 141,978 according to SEQ ID NO:7, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a thymine at a position corresponding to position 132,939 according to SEQ ID NO:2, or the complement thereof; a guanine at a position corresponding to position 143,698 according to SEQ ID NO:3, or the complement thereof; a thymine at a position corresponding to position 141,048 according to SEQ ID NO:4, or the complement thereof; an adenine at a position corresponding to position 73,039 according to SEQ ID NO:5, or the complement thereof; a cytosine at a position corresponding to position 121,307 according to SEQ ID NO:6, or the complement thereof; or a cytosine at a position corresponding to position 141,978 according to SEQ ID NO:7, or the complement thereof; and d) detecting the detectable label.

In some embodiments, the determining step, detecting step, or genotyping assay comprises: a) amplifying at least a portion of the mRNA molecule that encodes the human ARHGEF12 polypeptide, wherein the amplified portion comprises: i) a uracil at a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, or position 2,615 according to SEQ ID NO:23 or the complement thereof; ii) a guanine at a position corresponding to: position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, or position 3,614 according to SEQ ID NO:30, or the complement thereof; or iii) a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) a uracil at a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, or position 2,615 according to SEQ ID NO:23 or the complement thereof; ii) a guanine at a position corresponding to: position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, or position 3,614 according to SEQ ID NO:30 or the complement thereof; or iii) a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; and d) detecting the detectable label.

In some embodiments, the determining step, detecting step, or genotyping assay comprises: a) amplifying at least a portion of the cDNA molecule that encodes the human ARHGEF12 polypeptide, wherein the amplified portion comprises: i) a thymine at a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54 or the complement thereof; ii) a guanine at a position corresponding to: position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, or position 3,614 according to SEQ ID NO:61 or the complement thereof; or iii) a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) a thymine at a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54 or the complement thereof; or ii) a guanine at a position corresponding to: position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, or position 3,614 according to SEQ ID NO:61 or the complement thereof; or iii) a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof; and d) detecting the detectable label.

In some embodiments, the nucleic acid molecule is mRNA and the determining step further comprises reverse-transcribing the mRNA into a cDNA prior to the amplifying step.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) a thymine at a position corresponding to position 132,939 according to SEQ ID NO:2, or the complement thereof; ii) a uracil at a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, or position 2,615 according to SEQ ID NO:23 or the complement thereof; and/or iii) a thymine at a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54 or the complement thereof, and detecting the detectable label.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) a guanine at a position corresponding to position 143,698 according to SEQ ID NO:3 or the complement thereof; ii) a guanine at a position corresponding to: position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, or position 3,614 according to SEQ ID NO:30 or the complement thereof; and/or iii) a guanine at a position corresponding to: position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, or position 3,614 according to SEQ ID NO:61 or the complement thereof, and detecting the detectable label.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) a thymine at a position corresponding to position 141,048 according to SEQ ID NO:4 or the complement thereof; ii) a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; and/or iii) a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof, and detecting the detectable label.

In some embodiments, the determining step, detecting step, or genotyping assay comprises contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising an adenine at a position corresponding to position 73,039 according to SEQ ID NO:5, or the complement thereof, and detecting the detectable label.

In some embodiments, the determining step, detecting step, or genotyping assay comprises contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising a cytosine at a position corresponding to position 121,307 according to SEQ ID NO:6, or the complement thereof, and detecting the detectable label.

In some embodiments, the determining step, detecting step, or genotyping assay comprises contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising a cytosine at a position corresponding to position 141,978 according to SEQ ID NO:7, or the complement thereof, and detecting the detectable label.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a thymine at a position corresponding to position 132,939 according to SEQ ID NO:2, or the complement thereof; a guanine at a position corresponding to position 143,698 according to SEQ ID NO:3, or the complement thereof; a thymine at a position corresponding to position 141,048 according to SEQ ID NO:4, or the complement thereof; an adenine at a position corresponding to position 73,039 according to SEQ ID NO:5, or the complement thereof; a cytosine at a position corresponding to position 121,307 according to SEQ ID NO:6, or the complement thereof; or a cytosine at a position corresponding to position 141,978 according to SEQ ID NO:7, or the complement thereof; and detecting the detectable label.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) a uracil at a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, position 2,615 according to SEQ ID NO:23 or the complement thereof, or position 4,748 according to SEQ ID NO:24 or the complement thereof; ii) a guanine at a position corresponding to: position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, position 3,614 according to SEQ ID NO:30 or the complement thereof, or position 4,297 according to SEQ ID NO:31 or the complement thereof; or iii) a uracil at a position corresponding to: position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; and detecting the detectable label.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) a thymine at a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54 or the complement thereof; ii) a guanine at a position corresponding to: position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, or position 3,614 according to SEQ ID NO:61 or the complement thereof; iii) a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof; and detecting the detectable label.

Alteration-specific polymerase chain reaction techniques can be used to detect mutations such as SNPs in a nucleic acid sequence. Alteration-specific primers can be used because the DNA polymerase will not extend when a mismatch with the template is present.

In some embodiments, the nucleic acid molecule in the sample is mRNA and the mRNA is reverse-transcribed into a cDNA prior to the amplifying step. In some embodiments, the nucleic acid molecule is present within a cell obtained from the subject.

In some embodiments, the assay comprises contacting the biological sample with a primer or probe, such as an alteration-specific primer or alteration-specific probe, that specifically hybridizes to an ARHGEF12 variant genomic sequence, variant mRNA sequence, or variant cDNA sequence and not the corresponding ARHGEF12 reference sequence under stringent conditions, and determining whether hybridization has occurred.

In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

In some embodiments, the methods utilize probes and primers of sufficient nucleotide length to bind to the target nucleotide sequence and specifically detect and/or identify a polynucleotide comprising an ARHGEF12 variant genomic nucleic acid molecule, variant mRNA molecule, or variant cDNA molecule. The hybridization conditions or reaction conditions can be determined by the operator to achieve this result. The nucleotide length may be any length that is sufficient for use in a detection method of choice, including any assay described or exemplified herein. Such probes and primers can hybridize specifically to a target nucleotide sequence under high stringency hybridization conditions. Probes and primers may have complete nucleotide sequence identity of contiguous nucleotides within the target nucleotide sequence, although probes differing from the target nucleotide sequence and that retain the ability to specifically detect and/or identify a target nucleotide sequence may be designed by conventional methods. Probes and primers can have about 80%, about 85%, about 90%, about 91%, about 92%, about 93%, about 94%, about 95%, about 96%, about 97%, about 98%, about 99%, or 100% sequence identity or complementarity with the nucleotide sequence of the target nucleic acid molecule.

In some embodiments, to determine whether an ARHGEF12 nucleic acid molecule (genomic nucleic acid molecule, mRNA molecule, or cDNA molecule), or complement thereof, within a biological sample comprises a nucleotide sequence comprising: a thymine at a position corresponding to position 132,939 according to SEQ ID NO:2 (genomic nucleic acid molecule); i) a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23 (for mRNA molecules); ii) a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54 (for cDNA molecules), the biological sample can be subjected to an amplification method using a primer pair that includes a first primer derived from the 5' flanking sequence adjacent to: a thymine at a position corresponding to position 132,939 according to SEQ ID NO:2; i) a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23; or ii) a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54; and a second primer derived from the 3' flanking sequence adjacent to: a thymine at a position corresponding to position 132,939 according to SEQ ID NO:2; i) a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23; or ii) a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54 to produce an amplicon that is indicative of the presence of the SNP at positions encoding: a thymine at a position corresponding to position 132,939 according to SEQ ID NO:2; i) a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23; or ii) a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising: a thymine at a position corresponding to position 132,939 according to SEQ ID NO:2; i) a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23; or ii) a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54, and at least 1, 2, 3, 4, 5, 6, 7, 8, 9, 10, or more nucleotides on each side of positions comprising: a thymine at a position corresponding to position 132,939 according to SEQ ID NO:2; i) a uracil at a position corresponding to: position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, or position 2,615 according to SEQ ID NO:23; or ii) a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54.

In some embodiments, to determine whether an ARHGEF12 nucleic acid molecule (genomic nucleic acid molecule, mRNA molecule, or cDNA molecule), or complement thereof, within a biological sample comprises a nucleotide sequence comprising: a guanine at a position corresponding to position 143,698 according to SEQ ID NO:3 (genomic nucleic acid molecule); i) a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30 (for mRNA molecules); ii) a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61 (for cDNA molecules), the biological sample can be subjected to an amplification method using a primer pair that includes a first primer derived from the 5' flanking sequence adjacent to: a guanine at a position corresponding to position 143,698 according to SEQ ID NO:3; i) a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; or ii) a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61; and a second primer derived from the 3' flanking sequence adjacent to: a guanine at a position corresponding to position 143,698 according to SEQ ID NO:3; i) a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; or ii) a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61 to produce an amplicon that is indicative of the presence of the SNP at positions encoding: a guanine at a position corresponding to position 143,698 according to SEQ ID NO:3; i) a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; or ii) a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising: a guanine at a position corresponding to position 143,698 according to SEQ ID NO:3; i) a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; or ii) a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61, and at least 1, 2, 3, 4, 5, 6, 7, 8, 9, 10, or more nucleotides on each side of positions comprising: a guanine at a position corresponding to position 143,698 according to SEQ ID NO:3; i) a guanine at a position corresponding to: position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, or position 3,614 according to SEQ ID NO:30; or iii) a guanine at a position corresponding to: position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61.

In some embodiments, to determine whether an ARHGEF12 nucleic acid molecule (genomic nucleic acid molecule, mRNA molecule, or cDNA molecule), or complement thereof, within a biological sample comprises a nucleotide sequence comprising: a thymine at a position corresponding to position 141,048 according to SEQ ID NO:4 (genomic nucleic acid molecule); i) a uracil at a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38 (for mRNA molecules); ii) a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69 (for cDNA molecules), the biological sample can be subjected to an amplification method using a primer pair that includes a first primer derived from the 5' flanking sequence adjacent to: a thymine at a position corresponding to position 141,048 according to SEQ ID NO:4; i) a uracil at a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38; or ii) a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69, and a second primer derived from the 3' flanking sequence adjacent to: a thymine at a position corresponding to position 141,048 according to SEQ ID NO:4; i) a uracil at a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38; or ii) a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69 to produce an amplicon that is indicative of the presence of the SNP at positions encoding: a thymine at a position corresponding to position 141,048 according to SEQ ID NO:4; i) a uracil at a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38; or ii) a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising: a thymine at a position corresponding to position 141,048 according to SEQ ID NO:4; i) a uracil at a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38; or ii) a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69, and at least 1, 2, 3, 4, 5, 6, 7, 8, 9, 10, or more nucleotides on each side of positions comprising: a thymine at a position corresponding to position 141,048 according to SEQ ID NO:4; i) a uracil at a position corresponding to: position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, or position 3,163 according to SEQ ID NO:38; or ii) a thymine at a position corresponding to: position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69.

In some embodiments, to determine whether an ARHGEF12 nucleic acid molecule (genomic nucleic acid molecule, mRNA molecule, or cDNA molecule), or complement thereof, within a biological sample comprises a nucleotide sequence comprising an adenine at a position corresponding to position 73,039 according to SEQ ID NO:5 (genomic nucleic acid molecule), the biological sample can be subjected to an amplification method using a primer pair that includes a first primer derived from the 5' flanking sequence adjacent to a cytosine at a position corresponding to position 73,039 according to SEQ ID NO:5, and a second primer derived from the 3' flanking sequence adjacent to a cytosine at a position corresponding to position 73,039 according to SEQ ID NO:5 to produce an amplicon that is indicative of the presence of the SNP at positions encoding a cytosine at a position corresponding to position 73,039 according to SEQ ID NO:5. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising an adenine at a position corresponding to position 73,039 according to SEQ ID NO:5 and at least 1, 2, 3, 4, 5, 6, 7, 8, 9, 10, or more nucleotides on each side of positions comprising an adenine at a position corresponding to position 73,039 according to SEQ ID NO:5.

In some embodiments, to determine whether an ARHGEF12 nucleic acid molecule (genomic nucleic acid molecule, mRNA molecule, or cDNA molecule), or complement thereof, within a biological sample comprises a nucleotide sequence comprising a cytosine at a position corresponding to position 121,307 according to SEQ ID NO:6 (genomic nucleic acid molecule), the biological sample can be subjected to an amplification method using a primer pair that includes a first primer derived from the 5' flanking sequence adjacent to a cytosine at a position corresponding to position 121,307 according to SEQ ID NO:6, and a second primer derived from the 3' flanking sequence adjacent to a cytosine at a position corresponding to position 121,307 according to SEQ ID NO:6 to produce an amplicon that is indicative of the presence of the SNP at positions encoding a cytosine at a position corresponding to position 121,307 according to SEQ ID NO:6. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a cytosine at a position corresponding to position 121,307 according to SEQ ID NO:6, and at least 1, 2, 3, 4, 5, 6, 7, 8, 9, 10, or more nucleotides on each side of positions comprising a cytosine at a position corresponding to position 121,307 according to SEQ ID NO:6.

In some embodiments, to determine whether an ARHGEF12 nucleic acid molecule (genomic nucleic acid molecule, mRNA molecule, or cDNA molecule), or complement thereof, within a biological sample comprises a nucleotide sequence comprising a cytosine at a position corresponding to position 141,978 according to SEQ ID NO:7 (genomic nucleic acid molecule), the biological sample can be subjected to an amplification method using a primer pair that includes a first primer derived from the 5' flanking sequence adjacent to a cytosine at a position corresponding to position 141,978 according to SEQ ID NO:7, and a second primer derived from the 3' flanking sequence adjacent to a cytosine at a position corresponding to position 141,978 according to SEQ ID NO:7 to produce an amplicon that is indicative of the presence of the SNP at positions encoding a cytosine at a position corresponding to position 141,978 according to SEQ ID NO:7. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a cytosine at a position corresponding to position 141,978 according to SEQ ID NO:7, and at least 1, 2, 3, 4, 5, 6, 7, 8, 9, 10, or more nucleotides on each side of positions comprising a cytosine at a position corresponding to position 141,978 according to SEQ ID NO:7.

Similar amplicons can be generated from the mRNA and/or cDNA sequences. PCR primer pairs can be derived from a known sequence, for example, by using computer programs intended for that purpose, such as the PCR primer analysis tool in Vector NTI version 10 (Informax Inc., Bethesda Md.); PrimerSelect (DNASTAR Inc., Madison, Wis.); and Primer3 (Version 0.4.0.COPYRGT., 1991, Whitehead Institute for Biomedical Research, Cambridge, Mass.). Additionally, the sequence can be visually scanned and primers manually identified using known guidelines.

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to or simultaneous with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

In hybridization techniques, stringent conditions can be employed such that a probe or primer will specifically hybridize to its target. In some embodiments, a polynucleotide primer or probe under stringent conditions will hybridize to its target sequence to a detectably greater degree than to other non-target sequences, such as, at least 2-fold, at least 3-fold, at least 4-fold, or more over background, including over 10-fold over background. In some embodiments, a polynucleotide primer or probe under stringent conditions will hybridize to its target nucleotide sequence to a detectably greater degree than to other nucleotide sequences by at least 2-fold. In some embodiments, a polynucleotide primer or probe under stringent conditions will hybridize to its target nucleotide sequence to a detectably greater degree than to other nucleotide sequences by at least 3-fold. In some embodiments, a polynucleotide primer or probe under stringent conditions will hybridize to its target nucleotide sequence to a detectably greater degree than to other nucleotide sequences by at least 4-fold. In some embodiments, a polynucleotide primer or probe under stringent conditions will hybridize to its target nucleotide sequence to a detectably greater degree than to other nucleotide sequences by over 10-fold over background. Stringent conditions are sequence-dependent and will be different in different circumstances.

Appropriate stringency conditions which promote DNA hybridization, for example, 6× sodium chloride/sodium citrate (SSC) at about 45° C., followed by a wash of 2×SSC at 50° C., are known or can be found in *Current Protocols in Molecular Biology*, John Wiley & Sons, N.Y. (1989), 6.3.1-6.3.6. Typically, stringent conditions for hybridization and detection will be those in which the salt concentration is less than about 1.5 M Na$^+$ ion, typically about 0.01 to 1.0 M Na$^+$ ion concentration (or other salts) at pH 7.0 to 8.3 and the temperature is at least about 30° C. for short probes (such as, for example, 10 to 50 nucleotides) and at least about 60° C. for longer probes (such as, for example, greater than 50 nucleotides). Stringent conditions may also be achieved with the addition of destabilizing agents such as formamide. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

The present disclosure also provides methods of detecting the presence of a human ARHGEF12 predicted loss-of-function polypeptide or a human ARHGEF12 predicted gain-of-function polypeptide comprising performing an assay on a biological sample obtained from a subject to determine whether an ARHGEF12 polypeptide in the subject contains one or more variations that causes the polypeptide to have a loss-of-function (partial or complete) or predicted loss-of-function (partial or complete) or have a gain-of-function (partial or complete) or predicted gain-of-function (partial or complete). The ARHGEF12 predicted gain-of-function polypeptide can be any of the ARHGEF12 variant polypeptides described herein. In some embodiments, the methods detect the presence of ARHGEF12 Tyr973Phe, Tyr954Phe, or Tyr870Phe. In some embodiments, the methods detect the presence of ARHGEF12 Tyr973Phe. The ARHGEF12 predicted loss-of-function polypeptide can be any of the ARHGEF12 variant polypeptides described herein. In some embodiments, the methods detect the presence of ARHGEF12 Tyr1306Cys, Tyr1287Cys, Tyr1203Cys, Glu1156STOP, Glu1137STOP, or Glu1053STOP. In some embodiments, the methods detect the presence of ARHGEF12 Tyr1306Cys.

In some embodiments, the methods comprise performing an assay on a sample obtained from a subject to determine whether an ARHGEF12 polypeptide in the sample comprises a phenylalanine at a position corresponding to: position 973 according to SEQ ID NO:74, position 954 according to SEQ ID NO:75, position 870 according to SEQ ID NO:76, or position 870 according to SEQ ID NO:77. In some embodiments, the methods comprise performing an assay on a sample obtained from a subject to determine whether an ARHGEF12 polypeptide in the sample comprises: a cysteine at a position corresponding to: position 1,306 according to SEQ ID NO:78, position 1,287 according to SEQ ID NO:79, or position 1,203 according to SEQ ID NO:80. In some embodiments, the methods comprise performing an assay on a sample obtained from a subject to determine whether an ARHGEF12 polypeptide in the sample terminates at a position corresponding to: position 1,155 according to SEQ ID NO:81, position 1,136 according to SEQ ID NO:82, or position 1,052 according to SEQ ID NO:83.

In some embodiments, the detecting step comprises sequencing at least a portion of the polypeptide that comprises a position corresponding to: position 973 according to SEQ ID NO:74 or SEQ ID NO:70, position 954 according to SEQ ID NO:75 or SEQ ID NO:71, position 870 according to SEQ ID NO:76 or SEQ ID NO:72, or position 870 according to SEQ ID NO:77 or SEQ ID NO:73. In some embodiments, the detecting step comprises sequencing at least a portion of the polypeptide that comprises a position corresponding to: position 1,306 according to SEQ ID NO:78 or SEQ ID NO:70, position 1,287 according to SEQ ID NO:79 or SEQ ID NO:71, or position 1,203 according to SEQ ID NO:80. In some embodiments, the detecting step comprises sequencing at least a portion of the polypeptide that comprises a position corresponding to: position 1,156 according to SEQ ID NO:81 or SEQ ID NO:70, position 1,137 according to SEQ ID NO:82 or SEQ ID NO:71, or position 1,053 according to SEQ ID NO:83 or SEQ ID NO:72.

In some embodiments, the detecting step comprises an immunoassay for detecting the presence of a polypeptide that comprises a position corresponding to: position 973 according to SEQ ID NO:74 or SEQ ID NO:70, position 954 according to SEQ ID NO:75 or SEQ ID NO:71, position 870 according to SEQ ID NO:76 or SEQ ID NO:72, or position 870 according to SEQ ID NO:77 or SEQ ID NO:74. In some embodiments, the detecting step comprises an immunoassay for detecting the presence of a polypeptide that comprises a position corresponding to: position 1,306 according to SEQ ID NO:78 or SEQ ID NO:70, position 1,287 according to SEQ ID NO:79 or SEQ ID NO:71, or position 1,203 according to SEQ ID NO:80 or SEQ ID NO:72. In some embodiments, the detecting step comprises an immunoassay for detecting the presence of a polypeptide that comprises a position corresponding to: position 1,156 according to SEQ ID NO:81 or SEQ ID NO:70, position 1,137 according to SEQ ID NO:82 or SEQ ID NO:71, or position 1,053 according to SEQ ID NO:83 or SEQ ID NO:72.

In some embodiments, when the subject does not have an ARHGEF12 predicted loss-of-function polypeptide, the subject has an increased risk for developing glaucoma and/or elevated IOP. In some embodiments, when the subject has an ARHGEF12 predicted loss-of-function polypeptide, the subject has a decreased risk for developing glaucoma and/or elevated IOP. In some embodiments, when the subject has an ARHGEF12 predicted gain-of-function polypeptide, the subject has an increased risk for developing glaucoma and/or elevated IOP.

The present disclosure also provides isolated nucleic acid molecules that hybridize to ARHGEF12 variant genomic nucleic acid molecules, ARHGEF12 variant mRNA molecules, and/or ARHGEF12 variant cDNA molecules (such as any of the genomic variant nucleic acid molecules, mRNA variant molecules, and cDNA variant molecules disclosed herein). In some embodiments, the isolated nucleic acid molecules hybridize to a portion of the ARHGEF12 nucleic acid molecule that includes a position corresponding to: position 132,939 according to SEQ ID NO:2, position 3,749 according to SEQ ID NO:16, position 3,191 according to SEQ ID NO:17, position 3,079 according to SEQ ID NO:18, position 3,692 according to SEQ ID NO:19, position 3,046 according to SEQ ID NO:20, position 2,925 according to SEQ ID NO:21, position 3,054 according to SEQ ID NO:22, position 2,615 according to SEQ ID NO:23, position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54.

In some embodiments, the isolated nucleic acid molecules hybridize to a portion of the ARHGEF12 nucleic acid molecule that includes a position corresponding to position 143,698 according to SEQ ID NO:3, position 4,748 according to SEQ ID NO:24, position 4,190 according to SEQ ID NO:25, position 4,078 according to SEQ ID NO:26, position 4,691 according to SEQ ID NO:27, position 4,045 according to SEQ ID NO:28, position 3,924 according to SEQ ID NO:29, position 3,614 according to SEQ ID NO:30, position 4,748 according to SEQ ID NO:55, position 4,190 according to SEQ ID NO:56, position 4,078 according to SEQ ID NO:57, position 4,691 according to SEQ ID NO:58, position 4,045 according to SEQ ID NO:59, position 3,924 according to SEQ ID NO:60, or position 3,614 according to SEQ ID NO:61.

In some embodiments, the isolated nucleic acid molecules hybridize to a portion of the ARHGEF12 nucleic acid molecule that includes a position corresponding to position 141,048 according to SEQ ID NO:4, position 4,297 according to SEQ ID NO:31, position 3,739 according to SEQ ID NO:32, position 3,627 according to SEQ ID NO:33, position 4,240 according to SEQ ID NO:34, position 3,594 according to SEQ ID NO:35, position 3,473 according to SEQ ID NO:36, position 3,602 according to SEQ ID NO:37, position 3,163 according to SEQ ID NO:38, position 4,297 according to SEQ ID NO:62, position 3,379 according to SEQ ID NO:63, position 3,627 according to SEQ ID NO:64, position 4,240 according to SEQ ID NO:65, position 3,594 according to SEQ ID NO:66, position 3,473 according to SEQ ID NO:67, position 3,602 according to SEQ ID NO:68, or position 3,163 according to SEQ ID NO:69.

In some embodiments, the isolated nucleic acid molecules hybridize to a portion of the ARHGEF12 nucleic acid molecule that includes a position corresponding to position 73,039 according to SEQ ID NO:5.

In some embodiments, the isolated nucleic acid molecules hybridize to a portion of the ARHGEF12 nucleic acid molecule that includes a position corresponding to position 121,307 according to SEQ ID NO:6.

In some embodiments, the isolated nucleic acid molecules hybridize to a portion of the ARHGEF12 nucleic acid molecule that includes a position corresponding to position 141,978 according to SEQ ID NO:7.

In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 200, at least about 300, at least about 400, at least about 500, at least about 600, at least about 700, at least about 800, at least about 900, at least about 1000, at least about 2000, at least about 3000, at least about 4000, or at least about 5000 nucleotides. In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, or at least about 25 nucleotides. In some embodiments, the isolated nucleic acid molecules comprise or consist of at least about 18 nucleotides. In some embodiments, the isolated nucleic acid molecules comprise or consists of at least about 15 nucleotides. In some embodiments, the isolated nucleic acid molecules consist of or comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides. In some embodiments, the isolated nucleic acid molecules consist of or comprise from about 18 to about 30 nucleotides. In some embodiments, the isolated nucleic acid molecules comprise or consist of at least about 15 nucleotides to at least about 35 nucleotides.

In some embodiments, such isolated nucleic acid molecules hybridize to ARHGEF12 variant nucleic acid molecules (such as genomic nucleic acid molecules, mRNA molecules, and/or cDNA molecules) under stringent conditions. Such nucleic acid molecules can be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein, and can be used in any of the methods described herein.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to ARHGEF12 variant genomic nucleic acid molecules, ARHGEF12 variant mRNA molecules, and/or ARHGEF12 variant cDNA molecules. In some embodiments, the isolated nucleic acid molecules consist of or comprise from about 15 to about 100 nucleotides, or from about 15 to about 35 nucleotides. In some embodiments, the isolated nucleic acid molecules consist of or comprise from about 15 to about 100 nucleotides. In some embodiments, the isolated nucleic acid molecules consist of or comprise from about 15 to about 35 nucleotides.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human ARHGEF12 polypeptide, wherein the portion comprises a position corresponding to: i) position 132,939 according to SEQ ID NO:2, or the complement thereof; ii) position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, or position 2,615 according to SEQ ID NO:23 or the complement thereof; and/or iii) position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54 or the complement thereof. In some embodiments, the alteration-specific probe or alteration-specific primer comprises a nucleotide sequence which is complementary to a portion of a nucleotide sequence comprising positions corresponding to: i) positions 132,938-132,940 according to SEQ ID NO:2, or the complement thereof; ii) positions 3,748-3-750 according to SEQ ID NO:16 or the complement thereof, positions 3,190-3,192 according to SEQ ID NO:17 or the complement thereof, positions 3,078-3,080 according to SEQ ID NO:18 or the complement thereof, positions 3,691-3,693 according to SEQ ID NO:19 or the complement thereof, positions 3,045-3,047 according to SEQ ID NO:20 or the complement thereof, positions 2,924-2,926 according to SEQ ID NO:21 or the complement thereof, positions 3,053-3,055 according to SEQ ID NO:22 or the complement thereof, or positions 2,614-2,616 according to SEQ ID NO:23 or the complement thereof; and/or iii) positions 3,748-3,750 according to SEQ ID NO:47 or the complement thereof, positions 3,190-3,192 according to SEQ ID NO:48 or the complement thereof, positions 3,078-3,080 according to SEQ ID NO:49 or the complement thereof, positions 3,691-3,693 according to SEQ ID NO:50 or the complement thereof, positions 3,045-3,047 according to SEQ ID NO:51 or the complement thereof, positions 2,924-2,926 according to SEQ ID NO:52 or the complement thereof, positions 3,053-3,055 according to SEQ ID NO:53 or the complement thereof, or positions 2,614-2,616 according to SEQ ID NO:54 or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human ARHGEF12 polypeptide, wherein the portion comprises a position corresponding to: i) position 143,698 according to SEQ ID NO:3 or the complement thereof; ii) position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, or position 3,614 according to SEQ ID NO:30 or the complement thereof; and/or iii) position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, or position 3,614 according to SEQ ID NO:61 or the complement thereof. In some embodiments, the alteration-specific probe or alteration-specific primer comprises a nucleotide sequence which is complementary to a portion of a nucleotide sequence comprising positions corresponding to: i) positions 143,697-143,699 according to SEQ ID NO:3 or the complement thereof; ii) positions 4,747-4,749 according to SEQ ID NO:24 or the complement thereof, positions 4,189-4,191 according to SEQ ID NO:25 or the complement thereof, positions 4,077-4,079 according to SEQ ID NO:26 or the complement thereof, positions 4,690-4,692 according to SEQ ID NO:27 or the complement thereof, positions 4,044-4,046 according to SEQ ID NO:28 or the complement thereof, positions 3,923-3,925 according to SEQ ID NO:29 or the complement thereof, or positions 3,613-3,615 according to SEQ ID NO:30 or the complement thereof; and/or iii) positions 4,747-4,749 according to SEQ ID NO:55 or the complement thereof, 4,189-4,191 according to SEQ ID NO:56 or the complement thereof, positions 4,077-4,079 according to SEQ ID NO:57 or the complement thereof, positions 4,690-4,692 according to SEQ ID NO:58 or the complement thereof, positions 4,044-4,046 according to SEQ ID NO:59 or the complement thereof, positions 3,923-3,925 according to SEQ ID NO:60 or the complement thereof, or positions 3,613-3,615 according to SEQ ID NO:61 or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human ARHGEF12 polypeptide, wherein the portion comprises a position corresponding to: i) position 141,048 according to SEQ ID NO:4 or the complement thereof; ii) position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; and/or iii) position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof. In some embodiments, the alteration-specific probe or alteration-specific primer comprises a nucleotide sequence which is complementary to a portion of a nucleotide sequence comprising positions corresponding to: i) positions 141,048-141,050 according to SEQ ID NO:4 or the complement thereof; ii) positions 4,297-4,299 according to SEQ ID NO:31 or the complement thereof, positions 3,739-3,741 according to SEQ ID NO:32 or the complement thereof, positions 3,627-3,629 according to SEQ ID NO:33 or the complement thereof, positions 4,240-4,242 according to SEQ ID NO:34 or the complement thereof, positions 3,594-3,596 according to SEQ ID NO:35 or the complement thereof, positions 3,473-3,475 according to SEQ ID NO:36 or the complement thereof, positions 3,602-3,604 according to SEQ ID NO:37 or the complement thereof, or positions 3,163-3,165 according to SEQ ID NO:38 or the complement thereof; and/or iii) positions 4,297-4,299 according to SEQ ID NO:62 or the complement thereof, positions 3,739-3,741 according to SEQ ID NO:63 or the complement thereof, positions 3,627-3,629 according to SEQ ID NO:64 or the complement thereof, positions 4,240-4,242 according to SEQ ID NO:65 or the complement thereof, positions 3,594-3,596 according to SEQ ID NO:66 or the complement thereof, positions 3,473-3,475 according to SEQ ID NO:67 or the complement thereof, positions 3,602-3,604 according to SEQ ID NO:68 or the complement thereof, or positions 3,163-3,165 according to SEQ ID NO:69 or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human ARHGEF12 polypeptide, wherein the portion comprises a position corresponding to: position 73,039 according to SEQ ID NO:5, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human ARHGEF12 polypeptide, wherein the portion comprises a position corresponding to position 121,307 according to SEQ ID NO:6, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human ARHGEF12 polypeptide, wherein the portion comprises a position corresponding to position 141,978 according to SEQ ID NO:7, or the complement thereof In some embodiments, the alteration-specific probes and alteration-specific primers comprise DNA. In some embodiments, the alteration-specific probes and alteration-specific primers comprise RNA.

In some embodiments, the probes and primers described herein (including alteration-specific probes and alteration-specific primers) have a nucleotide sequence that specifically hybridizes to any of the nucleic acid molecules disclosed herein, or the complement thereof. In some embodiments, the probes and primers specifically hybridize to any of the nucleic acid molecules disclosed herein under stringent conditions.

In some embodiments, the primers, including alteration-specific primers, can be used in second generation sequencing or high throughput sequencing. In some instances, the primers, including alteration-specific primers, can be modified. In particular, the primers can comprise various modifications that are used at different steps of, for example, Massive Parallel Signature Sequencing (MPSS), Polony sequencing, and 454 Pyrosequencing. Modified primers can be used at several steps of the process, including biotinylated primers in the cloning step and fluorescently labeled primers used at the bead loading step and detection step. Polony sequencing is generally performed using a paired-end tags library wherein each molecule of DNA template is about 135 bp in length. Biotinylated primers are used at the bead loading step and emulsion PCR. Fluorescently labeled degenerate nonamer oligonucleotides are used at the detection step. An adaptor can contain a 5'-biotin tag for immobilization of the DNA library onto streptavidin-coated beads.

The probes and primers described herein can be used to detect a nucleotide variation within any of the ARHGEF12 variant genomic nucleic acid molecules, ARHGEF12 variant mRNA molecules, and/or ARHGEF12 variant cDNA molecules disclosed herein. The primers described herein can be used to amplify ARHGEF12 variant genomic nucleic acid molecules, ARHGEF12 variant mRNA molecules, or ARHGEF12 variant cDNA molecules, or a fragment thereof.

The present disclosure also provides pairs of primers comprising any of the primers described above. For example, if one of the primers' 3'-ends hybridizes to an adenine at a position corresponding to position 132,939 according to SEQ ID NO:1 (rather than thymine) in a particular ARHGEF12 nucleic acid molecule, then the presence of the amplified fragment would indicate the presence of an ARHGEF12 reference genomic nucleic acid molecule. Conversely, if one of the primers' 3'-ends hybridizes to a thymine at a position corresponding to position 132,939 according to SEQ ID NO:2 (rather than adenine) in a particular ARHGEF12 nucleic acid molecule, then the presence of the amplified fragment would indicate the presence of the ARHGEF12 variant genomic nucleic acid molecule. In some embodiments, the nucleotide of the primer complementary to the thymine at a position corresponding to position 132,939 according to SEQ ID NO:2 can be at the 3' end of the primer. In addition, if one of the primers' 3'-ends hybridizes to an adenine at a position corresponding to position 3,749 according to SEQ ID NO:8 (rather than uracil at position 3,749) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,749 according to SEQ ID NO:16 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,749 according to SEQ ID NO:16 can be at the 3' end of the primer. In addition, if one of the primers' 3'-ends hybridizes to an adenine at a position corresponding to position 3,191 according to SEQ ID NO:9 (rather than uracil at position 3,191) in a particular ARHGEF12 nucleic acid molecule, then the presence of the amplified fragment would indicate the presence of an ARHGEF12 reference mRNA molecule.

Conversely, if one of the primers' 3'-ends hybridizes to a uracil at a position corresponding to position 3,191 according to SEQ ID NO:17 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,191 according to SEQ ID NO:17 can be at the 3' end of the primer. In addition, if one of the primers' 3'-ends hybridizes to an adenine at a position corresponding to position 3,079 according to SEQ ID NO:10 (rather than uracil at position 3,079) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,079 according to SEQ ID NO:18 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,079 according to SEQ ID NO:18 can be at the 3' end of the primer. In addition, if one of the primers' 3'-ends hybridizes to an adenine at a position corresponding to position 3,692 according to SEQ ID NO:11 (rather than uracil at position 3,692) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,692 according to SEQ ID NO:19 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,692 according to SEQ ID NO:19 can be at the 3' end of the primer. In addition, if one of the primers' 3'-ends hybridizes to an adenine at a position corresponding to position 3,046 according to SEQ ID NO:12 (rather than uracil at position 3,046) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,046 according to SEQ ID NO:20 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,046 according to SEQ ID NO:20 can be at the 3' end of the primer. In addition, if one of the primers' 3'-ends hybridizes to an adenine at a position corresponding to position 2,925 according to SEQ ID NO:13 (rather than uracil at position 2,925) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 2,925 according to SEQ ID NO:21 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 2,925 according to SEQ ID NO:21 can be at the 3' end of the primer. In addition, if one of the primers' 3'-ends hybridizes to an adenine at a position corresponding to position 3,054 according to SEQ ID NO:14 (rather than uracil at position 3,054) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,054 according to SEQ ID NO:22 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,054 according to SEQ ID NO:22 can be at the 3' end of the primer. In addition, if one of the primers' 3'-ends hybridizes to an adenine at a position corresponding to position 2,615 according to SEQ ID NO:15 (rather than uracil at position 2,615) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 2,615 according to SEQ ID NO:23 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 2,615 according to SEQ ID NO:23 can be at the 3' end of the primer. In addition, if one of the primers' 3'-ends hybridizes to an adenine at a position corresponding to position 3,749 according to SEQ ID NO:39 (rather than thymine at position 3,749) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,749 according to SEQ ID NO:47 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,749 according to SEQ ID NO:47 can be at the 3' end of the primer. In addition, if one of the primers' 3'-ends hybridizes to an adenine at a position corresponding to position 3,191 according to SEQ ID NO:40 (rather than thymine at position 3,191) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,191 according to SEQ ID NO:48 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,191 according to SEQ ID NO:48 can be at the 3' end of the primer. In addition, if one of the primers' 3'-ends hybridizes to an adenine at a position corresponding to position 3,079 according to SEQ ID NO:41 (rather than thymine at position 3,079) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,079 according to SEQ ID NO:49 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,079 according to SEQ ID NO:49 can be at the 3' end of the primer. In addition, if one of the primers' 3'-ends hybridizes to an adenine at a position corresponding to position 3,692 according to SEQ ID NO:42 (rather than thymine at position 3,692) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,692 according to SEQ ID NO:50 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,692 according to SEQ ID NO:50 can be at the 3' end of the primer. In addition, if one of the primers' 3'-ends hybridizes to an adenine at a position corresponding to position 3,046 according to SEQ ID NO:43 (rather than thymine at position 3,046) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,046 according to SEQ ID NO:51 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,046 according to SEQ ID NO:51 can be at the 3' end of the primer. In addition, if one of the primers' 3'-ends hybridizes to an adenine at a position corresponding to position 2,925 according to SEQ ID NO:44 (rather than thymine at position 2,925) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 2,925 according to SEQ ID NO:52 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 2,925 according to SEQ ID NO:52 can be at the 3' end of the primer. In addition, if one of the primers' 3'-ends hybridizes to an adenine at a position corresponding to position 3,054 according to SEQ ID NO:45 (rather than thymine at position 3,054) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,054 according to SEQ ID NO:53 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,054 according to SEQ ID NO:53 can be at the 3' end of the primer. In addition, if one of the primers' 3'-ends hybridizes to an adenine at a position corresponding to position 2,615 according to SEQ ID NO:46 (rather than thymine at position 2,615) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 2,615 according to SEQ ID NO:54 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 2,615 according to SEQ ID NO:54 can be at the 3' end of the primer.

The present disclosure also provides pairs of primers comprising any of the primers described above. For example, if one of the primers' 3'-ends hybridizes to an adenine at a position corresponding to position 132,939 according to SEQ ID NO:1 (rather than guanine) in a particular ARHGEF12 nucleic acid molecule, then the presence of the amplified fragment would indicate the presence of an ARHGEF12 reference genomic nucleic acid molecule. Conversely, if one of the primers' 3'-ends hybridizes to a guanine at a position corresponding to position 143,698 according to SEQ ID NO:3 (rather than adenine) in a particular ARHGEF12 nucleic acid molecule, then the presence of the amplified fragment would indicate the presence of the ARHGEF12 variant genomic nucleic acid molecule. In some embodiments, the nucleotide of the primer complementary to the guanine at a position corresponding to position 143,698 according to SEQ ID NO:3 can be at the 3' end of the primer. In addition, if one of the primers' 3'-ends hybridizes to an adenine at a position corresponding to position 4,748 according to SEQ ID NO:8 (rather than guanine at position 4,748) in a particular ARHGEF12 nucleic acid molecule, then the presence of the amplified fragment would indicate the presence of an ARHGEF12 reference mRNA molecule. Conversely, if one of the primers' 3'-ends hybridizes to a guanine at a position corresponding to position 4,748 according to SEQ ID NO:24 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the guanine at a position corresponding to position 4,748 according to SEQ ID NO:24 can be at the 3' end of the primer. In addition, if one of the primers' 3'-ends hybridizes to an adenine at a position corresponding to position 4,190 according to SEQ ID NO:9 (rather than guanine at position 4,190) in a particular ARHGEF12 nucleic acid molecule, then the presence of the amplified fragment would indicate the presence of an ARHGEF12 reference mRNA molecule. Conversely, if one of the primers' 3'-ends hybridizes to a guanine at a position corresponding to position 4,190 according to SEQ ID NO:25 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the guanine at a position corresponding to position 4,190 according to SEQ ID NO:25 can be at the 3' end of the primer. In addition, if one of the primers' 3'-ends hybridizes to an adenine at a position corresponding to position 4,078 according to SEQ ID NO:10 (rather than guanine at position 4,078) in a particular ARHGEF12 nucleic acid molecule, then the presence of the amplified fragment would indicate the presence of an ARHGEF12 reference mRNA molecule. Conversely, if one of the primers' 3'-ends hybridizes to a guanine at a position corresponding to position 4,078 according to SEQ ID NO:26 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the guanine at a position corresponding to position 4,078 according to SEQ ID NO:26 can be at the 3' end of the primer. In addition, if one of the primers' 3'-ends hybridizes to an adenine at a position corresponding to position 4,691 according to SEQ ID NO:11 (rather than guanine at position 4,691) in a particular ARHGEF12 nucleic acid molecule, then the presence of the amplified fragment would indicate the presence of an ARHGEF12 reference mRNA molecule. Conversely, if one of the primers' 3'-ends hybridizes to a guanine at a position corresponding to position 4,691 according to SEQ ID NO:27 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the guanine at a position corresponding to position 4,691 according to SEQ ID NO:27 can be at the 3' end of the primer. In addition, if one of the primers' 3'-ends hybridizes to an adenine at a position corresponding to position 4,045 according to SEQ ID NO:12 (rather than guanine at position 4,045) in a particular ARHGEF12 nucleic acid molecule, then the presence of the amplified fragment would indicate the presence of an ARHGEF12 reference mRNA molecule. Conversely, if one of the primers' 3'-ends hybridizes to a guanine at a position corresponding to position 4,045 according to SEQ ID NO:28 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the guanine at a position corresponding to position 4,045 according to SEQ ID NO:28 can be at the 3' end of the primer. In addition, if one of the primers' 3'-ends hybridizes to an adenine at a position corresponding to position 3,924 according to SEQ ID NO:13 (rather than guanine at position 3,924) in a particular ARHGEF12 nucleic acid molecule, then the presence of the amplified fragment would indicate the presence of an ARHGEF12 reference mRNA molecule. Conversely, if one of the primers' 3'-ends hybridizes to a guanine at a position corresponding to position 3,924 according to SEQ ID NO:29 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the guanine at a position corresponding to position 3,924 according to SEQ ID NO:29 can be at the 3' end of the primer. In addition, if one of the primers' 3'-ends hybridizes to an adenine at a position corresponding to position 3,614 according to SEQ ID NO:15 (rather than guanine at position 3,614) in a particular ARHGEF12 nucleic acid molecule, then the presence of the amplified fragment would indicate the presence of an ARHGEF12 reference mRNA molecule. Conversely, if one of the primers' 3'-ends hybridizes to a guanine at a position corresponding to position 3,614 according to SEQ ID NO:30 (rather than adenine) in a particular ARHGEF12 mRNA molecule, then the presence of the amplified fragment would indicate the presence of the ARHGEF12 variant mRNA molecule. In some embodiments, the nucleotide of the primer complementary to the guanine at a position corresponding to position 3,614 according to SEQ ID NO:30 can be at the 3' end of the primer. In addition, if one of the primers' 3'-ends hybridizes to an adenine at a position corresponding to position 4,748 according to SEQ ID NO:39 (rather than guanine at position 4,748) in a particular ARHGEF12 nucleic acid molecule, then the presence of the amplified fragment would indicate the presence of an ARHGEF12 reference cDNA molecule. Conversely, if one of the primers' 3'-ends hybridizes to a guanine at a position corresponding to position 4,748 according to SEQ ID NO:55 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the guanine at a position corresponding to position 4,748 according to SEQ ID NO:55 can be at the 3' end of the primer. In addition, if one of the primers' 3'-ends hybridizes to an adenine at a position corresponding to position 4,190 according to SEQ ID NO:40 (rather than guanine at position 4,190) in a particular ARHGEF12 nucleic acid molecule, then the presence of the amplified fragment would indicate the presence of an ARHGEF12 reference cDNA molecule. Conversely, if one of the primers' 3'-ends hybridizes to a guanine at a position corresponding to position 4,190 according to SEQ ID NO:56 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the guanine at a position corresponding to position 4,190 according to SEQ ID NO:56 can be at the 3' end of the primer. In addition, if one of the primers' 3'-ends hybridizes to an adenine at a position corresponding to position 4,078 according to SEQ ID NO:41 (rather than guanine at position 4,078) in a particular ARHGEF12 nucleic acid molecule, then the presence of the amplified fragment would indicate the presence of an ARHGEF12 reference cDNA molecule. Conversely, if one of the primers' 3'-ends hybridizes to a guanine at a position corresponding to position 4,078 according to SEQ ID NO:57 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the guanine at a position corresponding to position 4,078 according to SEQ ID NO:57 can be at the 3' end of the primer. In addition, if one of the primers' 3'-ends hybridizes to an adenine at a position corresponding to position 4,691 according to SEQ ID NO:42 (rather than guanine at position 4,691) in a particular ARHGEF12 nucleic acid molecule, then the presence of the amplified fragment would indicate the presence of an ARHGEF12 reference cDNA molecule. Conversely, if one of the primers' 3'-ends hybridizes to a guanine at a position corresponding to position 4,691 according to SEQ ID NO:58 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the guanine at a position corresponding to position 4,691 according to SEQ ID NO:58 can be at the 3' end of the primer. In addition, if one of the primers' 3'-ends hybridizes to an adenine at a position corresponding to position 4,045 according to SEQ ID NO:43 (rather than guanine at position 4,045) in a particular ARHGEF12 nucleic acid molecule, then the presence of the amplified fragment would indicate the presence of an ARHGEF12 reference cDNA molecule. Conversely, if one of the primers' 3'-ends hybridizes to a guanine at a position corresponding to position 4,045 according to SEQ ID NO:59 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the guanine at a position corresponding to position 4,045 according to SEQ ID NO:59 can be at the 3' end of the primer. In addition, if one of the primers' 3'-ends hybridizes to an adenine at a position corresponding to position 3,924 according to SEQ ID NO:44 (rather than guanine at position 3,924) in a particular ARHGEF12 nucleic acid molecule, then the presence of the amplified fragment would indicate the presence of an ARHGEF12 reference cDNA molecule. Conversely, if one of the primers' 3'-ends hybridizes to a guanine at a position corresponding to position 3,924 according to SEQ ID NO:60 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the guanine at a position corresponding to position 3,924 according to SEQ ID NO:60 can be at the 3' end of the primer. In addition, if one of the primers' 3'-ends hybridizes to an adenine at a position corresponding to position 3,614 according to SEQ ID NO:46 (rather than guanine at position 3,614) in a particular ARHGEF12 nucleic acid molecule, then the presence of the amplified fragment would indicate the presence of an ARHGEF12 reference cDNA molecule. Conversely, if one of the primers' 3'-ends hybridizes to a guanine at a position corresponding to position 3,614 according to SEQ ID NO:61 (rather than adenine) in a particular ARHGEF12 cDNA molecule, then the presence of the amplified fragment would indicate the presence of the ARHGEF12 variant cDNA molecule. In some embodiments, the nucleotide of the primer complementary to the guanine at a position corresponding to position 3,614 according to SEQ ID NO:61 can be at the 3' end of the primer.

The present disclosure also provides pairs of primers comprising any of the primers described above. For example, if one of the primers' 3'-ends hybridizes to an adenine at a position corresponding to position 132,939 according to SEQ ID NO:1 (rather than thymine) in a particular ARHGEF12 nucleic acid molecule, then the presence of the amplified fragment would indicate the presence of an ARHGEF12 reference genomic nucleic acid molecule. Conversely, if one of the primers' 3'-ends hybridizes to a thymine at a position corresponding to position 141,048 according to SEQ ID NO:4 (rather than adenine) in a particular ARHGEF12 nucleic acid molecule, then the presence of the amplified fragment would indicate the presence of the ARHGEF12 variant genomic nucleic acid molecule. In some embodiments, the nucleotide of the primer complementary to the thymine at a position corresponding to position 141,048 according to SEQ ID NO:4 can be at the 3' end of the primer. In addition, if one of the primers' 3'-ends hybridizes to a guanine at a position corresponding to position 4,297 according to SEQ ID NO:8 (rather than uracil at position 4,297) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 4,297 according to SEQ ID NO:31 (rather than guanine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 4,297 according to SEQ ID NO:31 can be at the 3' end of the primer. In addition, if one of the primers' 3'-ends hybridizes to a guanine at a position corresponding to position 3,739 according to SEQ ID NO:9 (rather than uracil at position 3,739) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,739 according to SEQ ID NO:32 (rather than guanine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,739 according to SEQ ID NO:32 can be at the 3' end of the primer. In addition, if one of the primers' 3'-ends hybridizes to a guanine at a position corresponding to position 3,627 according to SEQ ID NO:10 (rather than uracil at position 3,627) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,627 according to SEQ ID NO:33 (rather than guanine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,627 according to SEQ ID NO:33 can be at the 3' end of the primer. In addition, if one of the primers' 3'-ends hybridizes to a guanine at a position corresponding to position 4,240 according to SEQ ID NO:11 (rather than uracil at position 4,240) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 4,240 according to SEQ ID NO:34 (rather than guanine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 4,240 according to SEQ ID NO:34 can be at the 3' end of the primer. In addition, if one of the primers' 3'-ends hybridizes to a guanine at a position corresponding to position 3,594 according to SEQ ID NO:12 (rather than uracil at position 3,594) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,594 according to SEQ ID NO:35 (rather than guanine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,594 according to SEQ ID NO:35 can be at the 3' end of the primer. In addition, if one of the primers' 3'-ends hybridizes to a guanine at a position corresponding to position 3,473 according to SEQ ID NO:13 (rather than uracil at position 3,473) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,473 according to SEQ ID NO:36 (rather than guanine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,473 according to SEQ ID NO:36 can be at the 3' end of the primer. In addition, if one of the primers' 3'-ends hybridizes to a guanine at a position corresponding to position 3,602 according to SEQ ID NO:14 (rather than uracil at position 3,602) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,602 according to SEQ ID NO:37 (rather than guanine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,602 according to SEQ ID NO:37 can be at the 3' end of the primer. In addition, if one of the primers' 3'-ends hybridizes to a guanine at a position corresponding to position 3,163 according to SEQ ID NO:15 (rather than uracil at position 3,163) in a particular ARHGEF12 nucleic acid molecule, then the presence of the amplified fragment would indicate the presence of an ARHGEF12 reference mRNA molecule. Conversely, if one of the primers' 3'-ends hybridizes to a uracil at a position corresponding to position 3,163 according to SEQ ID NO:38 (rather than guanine) in a particular ARHGEF12 mRNA molecule, then the presence of the amplified fragment would indicate the presence of the ARHGEF12 variant mRNA molecule. In some embodiments, the nucleotide of the primer complementary to the uracil at a position corresponding to position 3,163 according to SEQ ID NO:38 can be at the 3' end of the primer. In addition, if one of the primers' 3'-ends hybridizes to a guanine at a position corresponding to position 4,297 according to SEQ ID NO:39 (rather than thymine at position 4,297) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 4,297 according to SEQ ID NO:62 (rather than guanine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 4,297 according to SEQ ID NO:62 can be at the 3' end of the primer. In addition, if one of the primers' 3'-ends hybridizes to a guanine at a position corresponding to position 3,379 according to SEQ ID NO:40 (rather than thymine at position 3,379) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,379 according to SEQ ID NO:63 (rather than guanine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,379 according to SEQ ID NO:63 can be at the 3' end of the primer. In addition, if one of the primers' 3'-ends hybridizes to a guanine at a position corresponding to position 3,627 according to SEQ ID NO:41 (rather than thymine at position 3,627) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,627 according to SEQ ID NO:64 (rather than guanine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,627 according to SEQ ID NO:64 can be at the 3' end of the primer. In addition, if one of the primers' 3'-ends hybridizes to a guanine at a position corresponding to position 4,240 according to SEQ ID NO:42 (rather than thymine at position 4,240) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 4,240 according to SEQ ID NO:65 (rather than guanine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 4,240 according to SEQ ID NO:65 can be at the 3' end of the primer. In addition, if one of the primers' 3'-ends hybridizes to a guanine at a position corresponding to position 3,594 according to SEQ ID NO:43 (rather than thymine at position 3,594) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,594 according to SEQ ID NO:66 (rather than guanine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,594 according to SEQ ID NO:66 can be at the 3' end of the primer. In addition, if one of the primers' 3'-ends hybridizes to a guanine at a position corresponding to position 3,473 according to SEQ ID NO:44 (rather than thymine at position 3,473) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,473 according to SEQ ID NO:67 (rather than guanine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,473 according to SEQ ID NO:67 can be at the 3' end of the primer. In addition, if one of the primers' 3'-ends hybridizes to a guanine at a position corresponding to position 3,602 according to SEQ ID NO:45 (rather than thymine at position 3,602) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,602 according to SEQ ID NO:68 (rather than guanine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,602 according to SEQ ID NO:68 can be at the 3' end of the primer. In addition, if one of the primers' 3'-ends hybridizes to a guanine at a position corresponding to position 3,163 according to SEQ ID NO:46 (rather than thymine at position 3,163) in a particular ARHGEF12 nucleic acid molecule, then the presence of the amplified fragment would indicate the presence of an ARHGEF12 reference cDNA molecule. Conversely, if one of the primers' 3'-ends hybridizes to a thymine at a position corresponding to position 3,163 according to SEQ ID NO:69 (rather than guanine) in a particular ARHGEF12 cDNA molecule, then the presence of the amplified fragment would indicate the presence of the ARHGEF12 variant cDNA molecule. In some embodiments, the nucleotide of the primer complementary to the thymine at a position corresponding to position 3,163 according to SEQ ID NO:69 can be at the 3' end of the primer.

The present disclosure also provides pairs of primers comprising any of the primers described above. For example, if one of the primers' 3'-ends hybridizes to an adenine at a position corresponding to position 132,939 according to SEQ ID NO:1 (rather than adenine) in a particular ARHGEF12 nucleic acid molecule, then the presence of the amplified fragment would indicate the presence of an ARHGEF12 reference genomic nucleic acid molecule. Conversely, if one of the primers' 3'-ends hybridizes to an adenine at a position corresponding to position 73,039 according to SEQ ID NO:5 (rather than adenine) in a particular ARHGEF12 nucleic acid molecule, then the presence of the amplified fragment would indicate the presence of the ARHGEF12 variant genomic nucleic acid molecule. In some embodiments, the nucleotide of the primer complementary to the adenine at a position corresponding to position 73,039 according to SEQ ID NO:5 can be at the 3' end of the primer.

The present disclosure also provides pairs of primers comprising any of the primers described above. For example, if one of the primers' 3'-ends hybridizes to an adenine at a position corresponding to position 132,939 according to SEQ ID NO:1 (rather than cytosine) in a particular ARHGEF12 nucleic acid molecule, then the presence of the amplified fragment would indicate the presence of an ARHGEF12 reference genomic nucleic acid molecule. Conversely, if one of the primers' 3'-ends hybridizes to a cytosine at a position corresponding to position 121,307 according to SEQ ID NO:6 (rather than adenine) in a particular ARHGEF12 nucleic acid molecule, then the presence of the amplified fragment would indicate the presence of the ARHGEF12 variant genomic nucleic acid molecule. In some embodiments, the nucleotide of the primer complementary to the cytosine at a position corresponding to position 121,307 according to SEQ ID NO:6 can be at the 3' end of the primer.

The present disclosure also provides pairs of primers comprising any of the primers described above. For example, if one of the primers' 3'-ends hybridizes to an adenine at a position corresponding to position 132,939 according to SEQ ID NO:1 (rather than cytosine) in a particular ARHGEF12 nucleic acid molecule, then the presence of the amplified fragment would indicate the presence of an ARHGEF12 reference genomic nucleic acid molecule. Conversely, if one of the primers' 3'-ends hybridizes to a cytosine at a position corresponding to position 141,978 according to SEQ ID NO:7 (rather than adenine) in a particular ARHGEF12 nucleic acid molecule, then the presence of the amplified fragment would indicate the presence of the ARHGEF12 variant genomic nucleic acid molecule.

In the context of the disclosure "specifically hybridizes" means that the probe or primer (such as, for example, the alteration-specific probe or alteration-specific primer) does not hybridize to a nucleic acid sequence encoding an ARHGEF12 reference genomic nucleic acid molecule, an ARHGEF12 reference mRNA molecule, and/or an ARHGEF12 reference cDNA molecule.

In some embodiments, the probes (such as, for example, an alteration-specific probe) comprise a label. In some embodiments, the label is a fluorescent label, a radiolabel, or biotin.

The present disclosure also provides supports comprising a substrate to which any one or more of the probes disclosed herein is attached. Solid supports are solid-state substrates or supports with which molecules, such as any of the probes disclosed herein, can be associated. A form of solid support is an array. Another form of solid support is an array detector. An array detector is a solid support to which multiple different probes have been coupled in an array, grid, or other organized pattern. A form for a solid-state substrate is a microtiter dish, such as a standard 96-well type. In some embodiments, a multiwell glass slide can be employed that normally contains one array per well.

The present disclosure also provides molecular complexes comprising or consisting of any of the ARHGEF12 nucleic acid molecules (genomic nucleic acid molecules, mRNA molecules, or cDNA molecules), or complement thereof, described herein and any of the alteration-specific primers or alteration-specific probes described herein. In some embodiments, the ARHGEF12 nucleic acid molecules (genomic nucleic acid molecules, mRNA molecules, or cDNA molecules), or complement thereof, in the molecular complexes are single-stranded. In some embodiments, the ARHGEF12 nucleic acid molecule is any of the genomic nucleic acid molecules described herein. In some embodiments, the ARHGEF12 nucleic acid molecule is any of the mRNA molecules described herein. In some embodiments, the ARHGEF12 nucleic acid molecule is any of the cDNA molecules described herein. In some embodiments, the molecular complex comprises or consists of any of the ARHGEF12 nucleic acid molecules (genomic nucleic acid molecules, mRNA molecules, or cDNA molecules), or complement thereof, described herein and any of the alteration-specific primers described herein. In some embodiments, the molecular complex comprises or consists of any of the ARHGEF12 nucleic acid molecules (genomic nucleic acid molecules, mRNA molecules, or cDNA molecules), or complement thereof, described herein and any of the alteration-specific probes described herein.

In some embodiments, the molecular complex comprises or consists of an alteration-specific primer or an alteration-specific probe hybridized to a genomic nucleic acid molecule comprising a nucleotide sequence encoding an ARHGEF12 polypeptide, wherein the alteration-specific primer or the alteration-specific probe is hybridized to a thymine at a position corresponding to position 141,048 according to SEQ ID NO:4, or the complement thereof.

In some embodiments, the molecular complex comprises or consists of an alteration-specific primer or an alteration-specific probe that is hybridized to a TAA codon at positions corresponding to positions 141,048-141,050 according to SEQ ID NO:4.

In some embodiments, the molecular complex comprises or consists of a genomic nucleic acid molecule that comprises SEQ ID NO:4.

In some embodiments, the molecular complex comprises or consists of an alteration-specific primer or an alteration-specific probe hybridized to an mRNA molecule comprising a nucleotide sequence encoding a human ARHGEF12 polypeptide, wherein the alteration-specific primer or the alteration-specific probe is hybridized to a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof.

In some embodiments, the molecular complex comprises or consists of an alteration-specific primer or an alteration-specific probe that is hybridized to a UAA codon at positions corresponding to: positions 4,297-4,299 according to SEQ ID NO:31, positions 3,739-3,741 according to SEQ ID NO:32, positions 3,627-3,629 according to SEQ ID NO:33, positions 4,240-4,242 according to SEQ ID NO:34, positions 3,594-3,596 according to SEQ ID NO:35, positions 3,473-3,475 according to SEQ ID NO:36, positions 3,602-3,604 according to SEQ ID NO:37, or positions 3,163-3,165 according to SEQ ID NO:38.

In some embodiments, the molecular complex comprises or consists of an mRNA molecule that comprises SEQ ID NO:31, SEQ ID NO:32, SEQ ID NO:33, SEQ ID NO:34, SEQ ID NO:35, SEQ ID NO:36, SEQ ID NO:37, or SEQ ID NO:38.

In some embodiments, the molecular complex comprises or consists of an alteration-specific primer or an alteration-specific probe hybridized to a cDNA molecule comprising a nucleotide sequence encoding a human ARHGEF12 polypeptide, wherein the alteration-specific primer or the alteration-specific probe is hybridized to a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof.

In some embodiments, the molecular complex comprises or consists of an alteration-specific primer or an alteration-specific probe that is hybridized to a TAA codon at positions corresponding to: positions 4,297-4,299 according to SEQ ID NO:62, positions 3,739-3,741 according to SEQ ID NO:63, positions 3,627-3,629 according to SEQ ID NO:64, positions 4,240-4,242 according to SEQ ID NO:65, positions 3,594-3,596 according to SEQ ID NO:66, positions 3,473-3,475 according to SEQ ID NO:67, positions 3,602-3,604 according to SEQ ID NO:68, or positions 3,163-3,165 according to SEQ ID NO:69.

In some embodiments, the molecular complex comprises or consists of a cDNA molecule that comprises SEQ ID NO:62, SEQ ID NO:63, SEQ ID NO:64, SEQ ID NO:65, SEQ ID NO:66, SEQ ID NO:67, SEQ ID NO:68, or SEQ ID NO:69.

In some embodiments, the molecular complex comprises an alteration-specific probe or an alteration-specific primer comprising a label. In some embodiments, the label is a fluorescent label, a radiolabel, or biotin. In some embodiments, the molecular complex further comprises a non-human polymerase.

The present disclosure also provides isolated nucleic acid molecules comprising a nucleotide sequence encoding a human ARHGEF12 variant polypeptide. In some embodiments, the ARHGEF12 variant polypeptide terminates at a position corresponding to position 1,155 according to SEQ ID NO:81, or the complement thereof. In some embodiments, the isolated nucleic acid molecule encodes an ARHGEF12 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:81, and terminates at a position corresponding to position 1,155 according to SEQ ID NO:81. In some embodiments, the isolated nucleic acid molecule encodes an ARHGEF12 variant polypeptide having an amino acid sequence that has at least about 90% sequence identity to SEQ ID NO:81, and terminates at a position corresponding to position 1,155 according to SEQ ID NO:81. In some embodiments, the isolated nucleic acid molecule encodes an ARHGEF12 variant polypeptide having an amino acid sequence that has at least about 92% sequence identity to SEQ ID NO:81, and terminates at a position corresponding to position 1,155 according to SEQ ID NO:81. In some embodiments, the isolated nucleic acid molecule encodes an ARHGEF12 variant polypeptide having an amino acid sequence that has at least about 94% sequence identity to SEQ ID NO:81, and terminates at a position corresponding to position 1,155 according to SEQ ID NO:81. In some embodiments, the isolated nucleic acid molecule encodes an ARHGEF12 variant polypeptide having an amino acid sequence that has at least about 96% sequence identity to SEQ ID NO:81, and terminates at a position corresponding to position 1,155 according to SEQ ID NO:81. In some embodiments, the isolated nucleic acid molecule encodes an ARHGEF12 variant polypeptide having an amino acid sequence that has at least about 98% sequence identity to SEQ ID NO:81, and terminates at a position corresponding to position 1,155 according to SEQ ID NO:81. In some embodiments, the nucleic acid molecule encodes an ARHGEF12 variant polypeptide comprising SEQ ID NO:81. In some embodiments, the nucleic acid molecule encodes an ARHGEF12 variant polypeptide consisting of SEQ ID NO:81.

In some embodiments, the ARHGEF12 variant polypeptide terminates at a position corresponding to position 1,136 according to SEQ ID NO:82, or the complement thereof. In some embodiments, the isolated nucleic acid molecule encodes an ARHGEF12 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:82, and terminates at a position corresponding to position 1,136 according to SEQ ID NO:82. In some embodiments, the isolated nucleic acid molecule encodes an ARHGEF12 variant polypeptide having an amino acid sequence that has at least about 90% sequence identity to SEQ ID NO:82, and terminates at a position corresponding to position 1,136 according to SEQ ID NO:82. In some embodiments, the isolated nucleic acid molecule encodes an ARHGEF12 variant polypeptide having an amino acid sequence that has at least about 92% sequence identity to SEQ ID NO:82, and terminates at a position corresponding to position 1,136 according to SEQ ID NO:82. In some embodiments, the isolated nucleic acid molecule encodes an ARHGEF12 variant polypeptide having an amino acid sequence that has at least about 94% sequence identity to SEQ ID NO:82, and terminates at a position corresponding to position 1,136 according to SEQ ID NO:82. In some embodiments, the isolated nucleic acid molecule encodes an ARHGEF12 variant polypeptide having an amino acid sequence that has at least about 96% sequence identity to SEQ ID NO:82, and terminates at a position corresponding to position 1,136 according to SEQ ID NO:82. In some embodiments, the isolated nucleic acid molecule encodes an ARHGEF12 variant polypeptide having an amino acid sequence that has at least about 98% sequence identity to SEQ ID NO:82, and terminates at a position corresponding to position 1,136 according to SEQ ID NO:82. In some embodiments, the nucleic acid molecule encodes an ARHGEF12 variant polypeptide comprising SEQ ID NO:82. In some embodiments, the nucleic acid molecule encodes an ARHGEF12 variant polypeptide consisting of SEQ ID NO:82.

In some embodiments, the ARHGEF12 variant polypeptide terminates at a position corresponding to position 1,052 according to SEQ ID NO:83, or the complement thereof. In some embodiments, the isolated nucleic acid molecule encodes an ARHGEF12 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:83, and terminates at a position corresponding to position 1,052 according to SEQ ID NO:83. In some embodiments, the isolated nucleic acid molecule encodes an ARHGEF12 variant polypeptide having an amino acid sequence that has at least about 90% sequence identity to SEQ ID NO:83, and terminates at a position corresponding to position 1,052 according to SEQ ID NO:83. In some embodiments, the isolated nucleic acid molecule encodes an ARHGEF12 variant polypeptide having an amino acid sequence that has at least about 92% sequence identity to SEQ ID NO:83, and terminates at a position corresponding to position 1,052 according to SEQ ID NO:83. In some embodiments, the isolated nucleic acid molecule encodes an ARHGEF12 variant polypeptide having an amino acid sequence that has at least about 94% sequence identity to SEQ ID NO:83, and terminates at a position corresponding to position 1,052 according to SEQ ID NO:83. In some embodiments, the isolated nucleic acid molecule encodes an ARHGEF12 variant polypeptide having an amino acid sequence that has at least about 96% sequence identity to SEQ ID NO:83, and terminates at a position corresponding to position 1,052 according to SEQ ID NO:83. In some embodiments, the isolated nucleic acid molecule encodes an ARHGEF12 variant polypeptide having an amino acid sequence that has at least about 98% sequence identity to SEQ ID NO:83, and terminates at a position corresponding to position 1,052 according to SEQ ID NO:83. In some embodiments, the nucleic acid molecule encodes an ARHGEF12 variant polypeptide comprising SEQ ID NO:83. In some embodiments, the nucleic acid molecule encodes an ARHGEF12 variant polypeptide consisting of SEQ ID NO:83.

The nucleotide sequence of an ARHGEF12 reference genomic nucleic acid molecule is set forth in SEQ ID NO:1. Referring to SEQ ID NO:1, position 132,939 is an adenine. Referring to SEQ ID NO:1, position 143,698 is an adenine. Referring to SEQ ID NO:1, position 141,048 is a guanine. Referring to SEQ ID NO:1, position 73,039 is a guanine. Referring to SEQ ID NO:1, position 121,307 is an adenine. Referring to SEQ ID NO:1, position 141,978 is a guanine.

A variant genomic nucleic acid molecule of ARHGEF12 exists, wherein the adenine at position 132,939 (referring to SEQ ID NO:1) is replaced with thymine. The nucleotide sequence of this ARHGEF12 variant genomic nucleic acid molecule is set forth in SEQ ID NO:2.

Another variant genomic nucleic acid molecule of ARHGEF12 exists, wherein the adenine at position 143,698 (referring to SEQ ID NO:1) is replaced with guanine. The nucleotide sequence of this ARHGEF12 variant genomic nucleic acid molecule is set forth in SEQ ID NO:3.

Another variant genomic nucleic acid molecule of ARHGEF12 exists, wherein the guanine at position 141,048 (referring to SEQ ID NO:1) is replaced with thymine. The nucleotide sequence of this ARHGEF12 variant genomic nucleic acid molecule is set forth in SEQ ID NO:4.

Another variant genomic nucleic acid molecule of ARHGEF12 exists, wherein the guanine at position 73,039 (referring to SEQ ID NO:1) is replaced with adenine. The nucleotide sequence of this ARHGEF12 variant genomic nucleic acid molecule is set forth in SEQ ID NO:5.

Another variant genomic nucleic acid molecule of ARHGEF12 exists, wherein the adenine at position 121,307 (referring to SEQ ID NO:1) is replaced with cytosine. The nucleotide sequence of this ARHGEF12 variant genomic nucleic acid molecule is set forth in SEQ ID NO:6.

Another variant genomic nucleic acid molecule of ARHGEF12 exists, wherein the guanine at position 141,978 (referring to SEQ ID NO:1) is replaced with cytosine. The nucleotide sequence of this ARHGEF12 variant genomic nucleic acid molecule is set forth in SEQ ID NO:7.

The present disclosure also provides isolated genomic nucleic acid molecules comprising or consisting of a nucleotide sequence encoding a human ARHGEF12 polypeptide. In some embodiments, the isolated genomic nucleic acid molecule encodes an ARHGEF12 truncated variant polypeptide terminating at a position corresponding to position 1,155 according to SEQ ID NO:81. In some embodiments, the nucleotide sequence of the genomic nucleic acid molecule comprises a thymine at a position corresponding to position 141,048 according to SEQ ID NO:4, or the complement thereof. In some embodiments, the nucleotide sequence of the genomic nucleic acid molecule comprises a TAA codon at positions corresponding to positions 141,048-141,050 according to SEQ ID NO:4.

In some embodiments, the nucleotide sequence of the genomic nucleic acid molecule comprises an adenine at a position corresponding to position 73,039 according to SEQ ID NO:5, or the complement thereof.

In some embodiments, the isolated genomic nucleic acid molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:4, and comprises a thymine at a position corresponding to position 141,048 according to SEQ ID NO:4, or the complement thereof. In some embodiments, the isolated genomic nucleic acid molecules comprise or consist of a nucleotide sequence that has at least about 90% sequence identity to SEQ ID NO:4, and comprises a thymine at a position corresponding to position 141,048 according to SEQ ID NO:4, or the complement thereof. In some embodiments, the isolated genomic nucleic acid molecules comprise or consist of a nucleotide sequence that has at least about 92% sequence identity to SEQ ID NO:4, and comprises a thymine at a position corresponding to position 141,048 according to SEQ ID NO:4, or the complement thereof. In some embodiments, the isolated genomic nucleic acid molecules comprise or consist of a nucleotide sequence that has at least about 94% sequence identity to SEQ ID NO:4, and comprises a thymine at a position corresponding to position 141,048 according to SEQ ID NO:4, or the complement thereof. In some embodiments, the isolated genomic nucleic acid molecules comprise or consist of a nucleotide sequence that has at least about 96% sequence identity to SEQ ID NO:4, and comprises a thymine at a position corresponding to position 141,048 according to SEQ ID NO:4, or the complement thereof. In some embodiments, the isolated genomic nucleic acid molecules comprise or consist of a nucleotide sequence that has at least about 98% sequence identity to SEQ ID NO:4, and comprises a thymine at a position corresponding to position 141,048 according to SEQ ID NO:4, or the complement thereof.

In some embodiments, the isolated genomic nucleic acid molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:5, and comprises an adenine at a position corresponding to position 73,039 according to SEQ ID NO:5, or the complement thereof. In some embodiments, the isolated genomic nucleic acid molecules comprise or consist of a nucleotide sequence that has at least about 90% sequence identity to SEQ ID NO:5, and comprises an adenine at a position corresponding to position 73,039 according to SEQ ID NO:5, or the complement thereof. In some embodiments, the isolated genomic nucleic acid molecules comprise or consist of a nucleotide sequence that has at least about 92% sequence identity to SEQ ID NO:5, and comprises an adenine at a position corresponding to position 73,039 according to SEQ ID NO:5, or the complement thereof. In some embodiments, the isolated genomic nucleic acid molecules comprise or consist of a nucleotide sequence that has at least about 94% sequence identity to SEQ ID NO:5, and comprises an adenine at a position corresponding to position 73,039 according to SEQ ID NO:5, or the complement thereof. In some embodiments, the isolated genomic nucleic acid molecules comprise or consist of a nucleotide sequence that has at least about 96% sequence identity to SEQ ID NO:5, and comprises an adenine at a position corresponding to position 73,039 according to SEQ ID NO:5, or the complement thereof. In some embodiments, the isolated genomic nucleic acid molecules comprise or consist of a nucleotide sequence that has at least about 98% sequence identity to SEQ ID NO:5, and comprises an adenine at a position corresponding to position 73,039 according to SEQ ID NO:5, or the complement thereof.

Herein, if reference is made to percent sequence identity, the higher percentages of sequence identity are preferred over the lower ones.

In some embodiments, the isolated genomic nucleic acid molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:4, and comprises a TAA codon at positions corresponding to positions 141,048-141,050 according to SEQ ID NO:4, or the complement thereof. In some embodiments, the isolated genomic nucleic acid molecules comprise or consist of a nucleotide sequence that has at least about 90% sequence identity to SEQ ID NO:4, and comprises a TAA codon at positions corresponding to positions 141,048-141,050 according to SEQ ID NO:4, or the complement thereof. In some embodiments, the isolated genomic nucleic acid molecules comprise or consist of a nucleotide sequence that has at least about 92% sequence identity to SEQ ID NO:4, and comprises a TAA codon at positions corresponding to positions 141,048-141,050 according to SEQ ID NO:4, or the complement thereof. In some embodiments, the isolated genomic nucleic acid molecules comprise or consist of a nucleotide sequence that has at least about 94% sequence identity to SEQ ID NO:4, and comprises a TAA codon at positions corresponding to positions 141,048-141,050 according to SEQ ID NO:4, or the complement thereof. In some embodiments, the isolated genomic nucleic acid molecules comprise or consist of a nucleotide sequence that has at least about 96% sequence identity to SEQ ID NO:4, and comprises a TAA codon at positions corresponding to positions 141,048-141,050 according to SEQ ID NO:4, or the complement thereof. In some embodiments, the isolated genomic nucleic acid molecules comprise or consist of a nucleotide sequence that has at least about 98% sequence identity to SEQ ID NO:4, and comprises a TAA codon at positions corresponding to positions 141,048-141,050 according to SEQ ID NO:4, or the complement thereof.

Herein, if reference is made to percent sequence identity, the higher percentages of sequence identity are preferred over the lower ones.

In some embodiments, the isolated genomic nucleic acid molecules comprise SEQ ID NO:4. In some embodiments, the isolated genomic nucleic acid molecules consist of SEQ ID NO:4. In some embodiments, the isolated genomic nucleic acid molecules comprise SEQ ID NO:5. In some embodiments, the isolated genomic nucleic acid molecules consist of SEQ ID NO:5.

In some embodiments, the isolated genomic nucleic acid molecules comprise less than the entire genomic DNA sequence. In some embodiments, the isolated genomic nucleic acid molecules comprise or consist of at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, at least about 1000, at least about 2000, at least about 3000, at least about 4000, at least about 5000, at least about 6000, at least about 7000, at least about 8000, at least about 9000, or at least about 10000 contiguous nucleotides of any of the ARHGEF12 genomic nucleic acid molecules disclosed herein. In some embodiments, the isolated genomic nucleic acid molecules comprise or consist of at least about 1000 to at least about 2000 contiguous nucleotides of any of the ARHGEF12 genomic nucleic acid molecules disclosed herein. In some embodiments, these isolated genomic nucleic acid molecules comprise the thymine at a position corresponding to position 141,048 according to SEQ ID NO:4. In some embodiments, these isolated genomic nucleic acid molecules comprise the adenine at a position corresponding to position 73,039 according to SEQ ID NO:5.

The nucleotide sequence of an ARHGEF12 reference mRNA molecule is set forth in SEQ ID NO:8. Referring to SEQ ID NO:8, position 3,749 is an adenine. Referring to SEQ ID NO:8, position 4,748 is an adenine. Referring to SEQ ID NO:8, position 4,297 is a guanine.

The nucleotide sequence of another ARHGEF12 reference mRNA molecule is set forth in SEQ ID NO:9. Referring to SEQ ID NO:9, position 3,191 is an adenine. Referring to SEQ ID NO:9, position 4,190 is an adenine. Referring to SEQ ID NO:9, position 3,739 is a guanine.

The nucleotide sequence of another ARHGEF12 reference mRNA molecule is set forth in SEQ ID NO:10. Referring to SEQ ID NO:10, position 3,079 is an adenine. Referring to SEQ ID NO:10, position 4,078 is an adenine. Referring to SEQ ID NO:10, position 3,627 is a guanine.

The nucleotide sequence of another ARHGEF12 reference mRNA molecule is set forth in SEQ ID NO:11. Referring to SEQ ID NO:11, position 3,692 is an adenine. Referring to SEQ ID NO:11, position 4,691 is an adenine. Referring to SEQ ID NO:11, position 4,240 is a guanine.

The nucleotide sequence of another ARHGEF12 reference mRNA molecule is set forth in SEQ ID NO:12. Referring to SEQ ID NO:12, position 3,046 is an adenine. Referring to SEQ ID NO:12, position 4,045 is an adenine. Referring to SEQ ID NO:12, position 3,594 is a guanine.

The nucleotide sequence of another ARHGEF12 reference mRNA molecule is set forth in SEQ ID NO:13. Referring to SEQ ID NO:13, position 2,925 is an adenine. Referring to SEQ ID NO:13, position 3,924 is an adenine. Referring to SEQ ID NO:13, position 3,473 is a guanine.

The nucleotide sequence of another ARHGEF12 reference mRNA molecule is set forth in SEQ ID NO:14. Referring to SEQ ID NO:14, position 3,054 is an adenine. Referring to SEQ ID NO:14, position 3,602 is a guanine.

The nucleotide sequence of another ARHGEF12 reference mRNA molecule is set forth in SEQ ID NO:15. Referring to SEQ ID NO:15, position 2,615 is an adenine. Referring to SEQ ID NO:15, position 3,614 is an adenine. Referring to SEQ ID NO:15, position 3,163 is a guanine.

A variant mRNA molecule of ARHGEF12 exists, wherein the adenine at position 3,749 (referring to SEQ ID NO:8) is replaced with uracil. The nucleotide sequence of this ARHGEF12 variant mRNA molecule is set forth in SEQ ID NO:16.

Another variant mRNA molecule of ARHGEF12 exists, wherein the adenine at position 3,191 (referring to SEQ ID NO:9) is replaced with uracil. The nucleotide sequence of this ARHGEF12 variant mRNA molecule is set forth in SEQ ID NO:17.

Another variant mRNA molecule of ARHGEF12 exists, wherein the adenine at position 3,079 (referring to SEQ ID NO:10) is replaced with uracil. The nucleotide sequence of this ARHGEF12 variant mRNA molecule is set forth in SEQ ID NO:18.

Another variant mRNA molecule of ARHGEF12 exists, wherein the adenine at position 3,692 (referring to SEQ ID NO:11) is replaced with uracil. The nucleotide sequence of this ARHGEF12 variant mRNA molecule is set forth in SEQ ID NO:19.

Another variant mRNA molecule of ARHGEF12 exists, wherein the adenine at position 3,046 (referring to SEQ ID NO:12) is replaced with uracil. The nucleotide sequence of this ARHGEF12 variant mRNA molecule is set forth in SEQ ID NO:20.

Another variant mRNA molecule of ARHGEF12 exists, wherein the adenine at position 2,925 (referring to SEQ ID NO:13) is replaced with uracil. The nucleotide sequence of this ARHGEF12 variant mRNA molecule is set forth in SEQ ID NO:21.

Another variant mRNA molecule of ARHGEF12 exists, wherein the adenine at position 3,054 (referring to SEQ ID NO:14) is replaced with uracil. The nucleotide sequence of this ARHGEF12 variant mRNA molecule is set forth in SEQ ID NO:22.

Another variant mRNA molecule of ARHGEF12 exists, wherein the adenine at position 2,615 (referring to SEQ ID NO:15) is replaced with uracil. The nucleotide sequence of this ARHGEF12 variant mRNA molecule is set forth in SEQ ID NO:23.

A variant mRNA molecule of ARHGEF12 exists, wherein the adenine at position 4,748 (referring to SEQ ID NO:8) is replaced with guanine. The nucleotide sequence of this ARHGEF12 variant mRNA molecule is set forth in SEQ ID NO:24.

Another variant mRNA molecule of ARHGEF12 exists, wherein the adenine at position 4,190 (referring to SEQ ID NO:9) is replaced with guanine. The nucleotide sequence of this ARHGEF12 variant mRNA molecule is set forth in SEQ ID NO:25.

Another variant mRNA molecule of ARHGEF12 exists, wherein the adenine at position 4,078 (referring to SEQ ID NO:10) is replaced with guanine. The nucleotide sequence of this ARHGEF12 variant mRNA molecule is set forth in SEQ ID NO:26.

Another variant mRNA molecule of ARHGEF12 exists, wherein the adenine at position 4,691 (referring to SEQ ID NO:11) is replaced with guanine. The nucleotide sequence of this ARHGEF12 variant mRNA molecule is set forth in SEQ ID NO:27.

Another variant mRNA molecule of ARHGEF12 exists, wherein the adenine at position 4,045 (referring to SEQ ID NO:12) is replaced with guanine. The nucleotide sequence of this ARHGEF12 variant mRNA molecule is set forth in SEQ ID NO:28.

Another variant mRNA molecule of ARHGEF12 exists, wherein the adenine at position 3,924 (referring to SEQ ID NO:13) is replaced with guanine. The nucleotide sequence of this ARHGEF12 variant mRNA molecule is set forth in SEQ ID NO:29.

Another variant mRNA molecule of ARHGEF12 exists, wherein the adenine at position 3,614 (referring to SEQ ID NO:15) is replaced with guanine. The nucleotide sequence of this ARHGEF12 variant mRNA molecule is set forth in SEQ ID NO:30.

Another variant mRNA molecule of ARHGEF12 exists, wherein the guanine at position 4,297 (referring to SEQ ID NO:8) is replaced with uracil, and the GAA codon at positions 4,297 to 4,299 according to SEQ ID NO:8 is replaced with a STOP codon UAA. The nucleotide sequence of this ARHGEF12 variant mRNA molecule is set forth in SEQ ID NO:31.

Another variant mRNA molecule of ARHGEF12 exists, wherein the guanine at position 3,739 (referring to SEQ ID NO:9) is replaced with uracil, and the GAA codon at positions 3,739 to 3,741 according to SEQ ID NO:9 is replaced with a STOP codon UAA. The nucleotide sequence of this ARHGEF12 variant mRNA molecule is set forth in SEQ ID NO:32.

Another variant mRNA molecule of ARHGEF12 exists, wherein the guanine at position 3,627 (referring to SEQ ID NO:10) is replaced with uracil, and the GAA codon at positions 3,627 to 3,629 according to SEQ ID NO:10 is replaced with a STOP codon UAA. The nucleotide sequence of this ARHGEF12 variant mRNA molecule is set forth in SEQ ID NO:33.

Another variant mRNA molecule of ARHGEF12 exists, wherein the guanine at position 4,240 (referring to SEQ ID NO:11) is replaced with uracil, and the GAA codon at positions 4,240 to 4,242 according to SEQ ID NO:11 is replaced with a STOP codon UAA. The nucleotide sequence of this ARHGEF12 variant mRNA molecule is set forth in SEQ ID NO:34.

Another variant mRNA molecule of ARHGEF12 exists, wherein the guanine at position 3,594 (referring to SEQ ID NO:12) is replaced with uracil, and the GAA codon at positions 3,594 to 3,596 according to SEQ ID NO:12 is replaced with a STOP codon UAA. The nucleotide sequence of this ARHGEF12 variant mRNA molecule is set forth in SEQ ID NO:35.

Another variant mRNA molecule of ARHGEF12 exists, wherein the guanine at position 3,473 (referring to SEQ ID NO:13) is replaced with uracil, and the GAA codon at positions 3,473 to 3,475 according to SEQ ID NO:13 is replaced with a STOP codon UAA. The nucleotide sequence of this ARHGEF12 variant mRNA molecule is set forth in SEQ ID NO:36.

Another variant mRNA molecule of ARHGEF12 exists, wherein the guanine at position 3,602 (referring to SEQ ID NO:14) is replaced with uracil, and the GAA codon at positions 3,602 to 3,604 according to SEQ ID NO:14 is replaced with a STOP codon UAA. The nucleotide sequence of this ARHGEF12 variant mRNA molecule is set forth in SEQ ID NO:37.

Another variant mRNA molecule of ARHGEF12 exists, wherein the guanine at position 3,163 (referring to SEQ ID NO:15) is replaced with uracil, and the GAA codon at positions 3,163 to 3,165 according to SEQ ID NO:15 is replaced with a STOP codon UAA. The nucleotide sequence of this ARHGEF12 variant mRNA molecule is set forth in SEQ ID NO:38.

The present disclosure also provides isolated mRNA molecules comprising or consisting of a nucleotide sequence encoding a human ARHGEF12 polypeptide, wherein the nucleotide sequence comprises a uracil at a position corresponding to position 4,297 according to SEQ ID NO:31, or the complement thereof. In some embodiments, the isolated mRNA molecule comprises or consists of a nucleotide sequence encoding a human ARHGEF12 polypeptide, wherein the nucleotide sequence comprises a UAA codon at positions corresponding to positions 4,297-4,299 according to SEQ ID NO:31.

The present disclosure also provides isolated mRNA molecules comprising or consisting of a nucleotide sequence encoding a human ARHGEF12 polypeptide, wherein the nucleotide sequence comprises a uracil at a position corresponding to position 3,739 according to SEQ ID NO:32, or the complement thereof. In some embodiments, the isolated mRNA molecule comprises or consists of a nucleotide sequence encoding a human ARHGEF12 polypeptide, wherein the nucleotide sequence comprises a UAA codon at positions corresponding to positions 3,739-3,741 according to SEQ ID NO:32.

The present disclosure also provides isolated mRNA molecules comprising or consisting of a nucleotide sequence encoding a human ARHGEF12 polypeptide, wherein the nucleotide sequence comprises a uracil at a position corresponding to position 3,627 according to SEQ ID NO:33, or the complement thereof. In some embodiments, the isolated mRNA molecule comprises or consists of a nucleotide sequence encoding a human ARHGEF12 polypeptide, wherein the nucleotide sequence comprises a UAA codon at positions corresponding to positions 3,627-3,629 according to SEQ ID NO:33.

The present disclosure also provides isolated mRNA molecules comprising or consisting of a nucleotide sequence encoding a human ARHGEF12 polypeptide, wherein the nucleotide sequence comprises a uracil at a position corresponding to position 4,240 according to SEQ ID NO:34, or the complement thereof. In some embodiments, the isolated mRNA molecule comprises or consists of a nucleotide sequence encoding a human ARHGEF12 polypeptide, wherein the nucleotide sequence comprises a UAA codon at positions corresponding to positions 4,240-4,242 according to SEQ ID NO:34.

The present disclosure also provides isolated mRNA molecules comprising or consisting of a nucleotide sequence encoding a human ARHGEF12 polypeptide, wherein the nucleotide sequence comprises a uracil at a position corresponding to position 3,594 according to SEQ ID NO:35, or the complement thereof. In some embodiments, the isolated mRNA molecule comprises or consists of a nucleotide sequence encoding a human ARHGEF12 polypeptide, wherein the nucleotide sequence comprises a UAA codon at positions corresponding to positions 3,594-3,596 according to SEQ ID NO:35.

The present disclosure also provides isolated mRNA molecules comprising or consisting of a nucleotide sequence encoding a human ARHGEF12 polypeptide, wherein the nucleotide sequence comprises a uracil at a position corresponding to position 3,473 according to SEQ ID NO:36, or the complement thereof. In some embodiments, the isolated mRNA molecule comprises or consists of a nucleotide sequence encoding a human ARHGEF12 polypeptide, wherein the nucleotide sequence comprises a UAA codon at positions corresponding to positions 3,473-3,475 according to SEQ ID NO:36.

The present disclosure also provides isolated mRNA molecules comprising or consisting of a nucleotide sequence encoding a human ARHGEF12 polypeptide, wherein the nucleotide sequence comprises a uracil at a position corresponding to position 3,602 according to SEQ ID NO:37, or the complement thereof. In some embodiments, the isolated mRNA molecule comprises or consists of a nucleotide sequence encoding a human ARHGEF12 polypeptide, wherein the nucleotide sequence comprises a UAA codon at positions corresponding to positions 3,602-3,604 according to SEQ ID NO:37.

The present disclosure also provides isolated mRNA molecules comprising or consisting of a nucleotide sequence encoding a human ARHGEF12 polypeptide, wherein the nucleotide sequence comprises a uracil at a position corresponding to position 3,163 according to SEQ ID NO:38, or the complement thereof. In some embodiments, the isolated mRNA molecule comprises or consists of a nucleotide sequence encoding a human ARHGEF12 polypeptide, wherein the nucleotide sequence comprises a UAA codon at positions corresponding to positions 3,163-3,165 according to SEQ ID NO:38.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:31, and comprises a uracil at a position corresponding to position 4,297 according to SEQ ID NO:31, or the complement thereof. In some embodiments, the isolated mRNA molecules comprise or consist of a nucleotide sequence that has at least about 90% sequence identity to SEQ ID NO:31, and comprises a uracil at a position corresponding to position 4,297 according to SEQ ID NO:31, or the complement thereof. In some embodiments, the isolated mRNA molecules comprise or consist of a nucleotide sequence that has at least about 92% sequence identity to SEQ ID NO:31, and comprises a uracil at a position corresponding to position 4,297 according to SEQ ID NO:31, or the complement thereof. In some embodiments, the isolated mRNA molecules comprise or consist of a nucleotide sequence that has at least about 94% sequence identity to SEQ ID NO:31, and comprises a uracil at a position corresponding to position 4,297 according to SEQ ID NO:31, or the complement thereof. In some embodiments, the isolated mRNA molecules comprise or consist of a nucleotide sequence that has at least about 96% sequence identity to SEQ ID NO:31, and comprises a uracil at a position corresponding to position 4,297 according to SEQ ID NO:31, or the complement thereof. In some embodiments, the isolated mRNA molecules comprise or consist of a nucleotide sequence that has at least about 98% sequence identity to SEQ ID NO:31, and comprises a uracil at a position corresponding to position 4,297 according to SEQ ID NO:31, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:32, and comprises a uracil at a position corresponding to position 3,739 according to SEQ ID NO:32, or the complement thereof. In some embodiments, the isolated mRNA molecules comprise or consist of a nucleotide sequence that has at least about 90% sequence identity to SEQ ID NO:32, and comprises a uracil at a position corresponding to position 3,739 according to SEQ ID NO:32, or the complement thereof. In some embodiments, the isolated mRNA molecules comprise or consist of a nucleotide sequence that has at least about 92% sequence identity to SEQ ID NO:32, and comprises a uracil at a position corresponding to position 3,739 according to SEQ ID NO:32, or the complement thereof. In some embodiments, the isolated mRNA molecules comprise or consist of a nucleotide sequence that has at least about 94% sequence identity to SEQ ID NO:32, and comprises a uracil at a position corresponding to position 3,739 according to SEQ ID NO:32, or the complement thereof. In some embodiments, the isolated mRNA molecules comprise or consist of a nucleotide sequence that has at least about 96% sequence identity to SEQ ID NO:32, and comprises a uracil at a position corresponding to position 3,739 according to SEQ ID NO:32, or the complement thereof. In some embodiments, the isolated mRNA molecules comprise or consist of a nucleotide sequence that has at least about 98% sequence identity to SEQ ID NO:32, and comprises a uracil at a position corresponding to position 3,739 according to SEQ ID NO:32, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:33, and comprises a uracil at a position corresponding to position 3,627 according to SEQ ID NO:33, or the complement thereof. In some embodiments, the isolated mRNA molecules comprise or consist of a nucleotide sequence that has at least about 90% sequence identity to SEQ ID NO:33, and comprises a uracil at a position corresponding to position 3,627 according to SEQ ID NO:33, or the complement thereof. In some embodiments, the isolated mRNA molecules comprise or consist of a nucleotide sequence that has at least about 92% sequence identity to SEQ ID NO:33, and comprises a uracil at a position corresponding to position 3,627 according to SEQ ID NO:33, or the complement thereof. In some embodiments, the isolated mRNA molecules comprise or consist of a nucleotide sequence that has at least about 94% sequence identity to SEQ ID NO:33, and comprises a uracil at a position corresponding to position 3,627 according to SEQ ID NO:33, or the complement thereof. In some embodiments, the isolated mRNA molecules comprise or consist of a nucleotide sequence that has at least about 96% sequence identity to SEQ ID NO:33, and comprises a uracil at a position corresponding to position 3,627 according to SEQ ID NO:33, or the complement thereof. In some embodiments, the isolated mRNA molecules comprise or consist of a nucleotide sequence that has at least about 98% sequence identity to SEQ ID NO:33, and comprises a uracil at a position corresponding to position 3,627 according to SEQ ID NO:33, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:34, and comprises a uracil at a position corresponding to position 4,240 according to SEQ ID NO:34, or the complement thereof. In some embodiments, the isolated mRNA molecules comprise or consist of a nucleotide sequence that has at least about 90% sequence identity to SEQ ID NO:34, and comprises a uracil at a position corresponding to position 4,240 according to SEQ ID NO:34, or the complement thereof. In some embodiments, the isolated mRNA molecules comprise or consist of a nucleotide sequence that has at least about 92% sequence identity to SEQ ID NO:34, and comprises a uracil at a position corresponding to position 4,240 according to SEQ ID NO:34, or the complement thereof. In some embodiments, the isolated mRNA molecules comprise or consist of a nucleotide sequence that has at least about 94% sequence identity to SEQ ID NO:34, and comprises a uracil at a position corresponding to position 4,240 according to SEQ ID NO:34, or the complement thereof. In some embodiments, the isolated mRNA molecules comprise or consist of a nucleotide sequence that has at least about 96% sequence identity to SEQ ID NO:34, and comprises a uracil at a position corresponding to position 4,240 according to SEQ ID NO:34, or the complement thereof. In some embodiments, the isolated mRNA molecules comprise or consist of a nucleotide sequence that has at least about 98% sequence identity to SEQ ID NO:34, and comprises a uracil at a position corresponding to position 4,240 according to SEQ ID NO:34, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:35, and comprises a uracil at a position corresponding to position 3,594 according to SEQ ID NO:35, or the complement thereof. In some embodiments, the isolated mRNA molecules comprise or consist of a nucleotide sequence that has at least about 90% sequence identity to SEQ ID NO:35, and comprises a uracil at a position corresponding to position 3,594 according to SEQ ID NO:35, or the complement thereof. In some embodiments, the isolated mRNA molecules comprise or consist of a nucleotide sequence that has at least about 92% sequence identity to SEQ ID NO:35, and comprises a uracil at a position corresponding to position 3,594 according to SEQ ID NO:35, or the complement thereof. In some embodiments, the isolated mRNA molecules comprise or consist of a nucleotide sequence that has at least about 94% sequence identity to SEQ ID NO:35, and comprises a uracil at a position corresponding to position 3,594 according to SEQ ID NO:35, or the complement thereof. In some embodiments, the isolated mRNA molecules comprise or consist of a nucleotide sequence that has at least about 96% sequence identity to SEQ ID NO:35, and comprises a uracil at a position corresponding to position 3,594 according to SEQ ID NO:35, or the complement thereof. In some embodiments, the isolated mRNA molecules comprise or consist of a nucleotide sequence that has at least about 98% sequence identity to SEQ ID NO:35, and comprises a uracil at a position corresponding to position 3,594 according to SEQ ID NO:35, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:36, and comprises a uracil at a position corresponding to position 3,473 according to SEQ ID NO:36, or the complement thereof. In some embodiments, the isolated mRNA molecules comprise or consist of a nucleotide sequence that has at least about 90% sequence identity to SEQ ID NO:36, and comprises a uracil at a position corresponding to position 3,473 according to SEQ ID NO:36, or the complement thereof. In some embodiments, the isolated mRNA molecules comprise or consist of a nucleotide sequence that has at least about 92% sequence identity to SEQ ID NO:36, and comprises a uracil at a position corresponding to position 3,473 according to SEQ ID NO:36, or the complement thereof. In some embodiments, the isolated mRNA molecules comprise or consist of a nucleotide sequence that has at least about 94% sequence identity to SEQ ID NO:36, and comprises a uracil at a position corresponding to position 3,473 according to SEQ ID NO:36, or the complement thereof. In some embodiments, the isolated mRNA molecules comprise or consist of a nucleotide sequence that has at least about 96% sequence identity to SEQ ID NO:36, and comprises a uracil at a position corresponding to position 3,473 according to SEQ ID NO:36, or the complement thereof. In some embodiments, the isolated mRNA molecules comprise or consist of a nucleotide sequence that has at least about 98% sequence identity to SEQ ID NO:36, and comprises a uracil at a position corresponding to position 3,473 according to SEQ ID NO:36, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:37, and comprises a uracil at a position corresponding to position 3,602 according to SEQ ID NO:37, or the complement thereof. In some embodiments, the isolated mRNA molecules comprise or consist of a nucleotide sequence that has at least about 90% sequence identity to SEQ ID NO:37, and comprises a uracil at a position corresponding to position 3,602 according to SEQ ID NO:37, or the complement thereof. In some embodiments, the isolated mRNA molecules comprise or consist of a nucleotide sequence that has at least about 92% sequence identity to SEQ ID NO:37, and comprises a uracil at a position corresponding to position 3,602 according to SEQ ID NO:37, or the complement thereof. In some embodiments, the isolated mRNA molecules comprise or consist of a nucleotide sequence that has at least about 94% sequence identity to SEQ ID NO:37, and comprises a uracil at a position corresponding to position 3,602 according to SEQ ID NO:37, or the complement thereof. In some embodiments, the isolated mRNA molecules comprise or consist of a nucleotide sequence that has at least about 96% sequence identity to SEQ ID NO:37, and comprises a uracil at a position corresponding to position 3,602 according to SEQ ID NO:37, or the complement thereof. In some embodiments, the isolated mRNA molecules comprise or consist of a nucleotide sequence that has at least about 98% sequence identity to SEQ ID NO:37, and comprises a uracil at a position corresponding to position 3,602 according to SEQ ID NO:37, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:38, and comprises a uracil at a position corresponding to position 3,163 according to SEQ ID NO:38, or the complement thereof. In some embodiments, the isolated mRNA molecules comprise or consist of a nucleotide sequence that has at least about 90% sequence identity to SEQ ID NO:38, and comprises a uracil at a position corresponding to position 3,163 according to SEQ ID NO:38, or the complement thereof. In some embodiments, the isolated mRNA molecules comprise or consist of a nucleotide sequence that has at least about 92% sequence identity to SEQ ID NO:38, and comprises a uracil at a position corresponding to position 3,163 according to SEQ ID NO:38, or the complement thereof. In some embodiments, the isolated mRNA molecules comprise or consist of a nucleotide sequence that has at least about 94% sequence identity to SEQ ID NO:38, and comprises a uracil at a position corresponding to position 3,163 according to SEQ ID NO:38, or the complement thereof. In some embodiments, the isolated mRNA molecules comprise or consist of a nucleotide sequence that has at least about 96% sequence identity to SEQ ID NO:38, and comprises a uracil at a position corresponding to position 3,163 according to SEQ ID NO:38, or the complement thereof. In some embodiments, the isolated mRNA molecules comprise or consist of a nucleotide sequence that has at least about 98% sequence identity to SEQ ID NO:38, and comprises a uracil at a position corresponding to position 3,163 according to SEQ ID NO:38, or the complement thereof.

Herein, if reference is made to percent sequence identity, the higher percentages of sequence identity are preferred over the lower ones.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:31, and comprises a UAA codon at positions corresponding to positions 4,297-4,299 according to SEQ ID NO:31, or the complement thereof. In some embodiments, the isolated mRNA molecules comprise or consist of a nucleotide sequence that has at least about 90% sequence identity to SEQ ID NO:31, and comprises a UAA codon at positions corresponding to positions 4,297-4,299 according to SEQ ID NO:31, or the complement thereof. In some embodiments, the isolated mRNA molecules comprise or consist of a nucleotide sequence that has at least about 92% sequence identity to SEQ ID NO:31, and comprises a UAA codon at positions corresponding to positions 4,297-4,299 according to SEQ ID NO:31, or the complement thereof. In some embodiments, the isolated mRNA molecules comprise or consist of a nucleotide sequence that has at least about 94% sequence identity to SEQ ID NO:31, and comprises a UAA codon at positions corresponding to positions 4,297-4,299 according to SEQ ID NO:31, or the complement thereof. In some embodiments, the isolated mRNA molecules comprise or consist of a nucleotide sequence that has at least about 96% sequence identity to SEQ ID NO:31, and comprises a UAA codon at positions corresponding to positions 4,297-4,299 according to SEQ ID NO:31, or the complement thereof. In some embodiments, the isolated mRNA molecules comprise or consist of a nucleotide sequence that has at least about 98% sequence identity to SEQ ID NO:31, and comprises a UAA codon at positions corresponding to positions 4,297-4,299 according to SEQ ID NO:31, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:32, and comprises a UAA codon at positions corresponding to positions 3,739-3,741 according to SEQ ID NO:32, or the complement thereof. In some embodiments, the isolated mRNA molecules comprise or consist of a nucleotide sequence that has at least about 90% sequence identity to SEQ ID NO:32, and comprises a UAA codon at positions corresponding to positions 3,739-3,741 according to SEQ ID NO:32, or the complement thereof. In some embodiments, the isolated mRNA molecules comprise or consist of a nucleotide sequence that has at least about 92% sequence identity to SEQ ID NO:32, and comprises a UAA codon at positions corresponding to positions 3,739-3,741 according to SEQ ID NO:32, or the complement thereof. In some embodiments, the isolated mRNA molecules comprise or consist of a nucleotide sequence that has at least about 94% sequence identity to SEQ ID NO:32, and comprises a UAA codon at positions corresponding to positions 3,739-3,741 according to SEQ ID NO:32, or the complement thereof. In some embodiments, the isolated mRNA molecules comprise or consist of a nucleotide sequence that has at least about 96% sequence identity to SEQ ID NO:32, and comprises a UAA codon at positions corresponding to positions 3,739-3,741 according to SEQ ID NO:32, or the complement thereof. In some embodiments, the isolated mRNA molecules comprise or consist of a nucleotide sequence that has at least about 98% sequence identity to SEQ ID NO:32, and comprises a UAA codon at positions corresponding to positions 3,739-3,741 according to SEQ ID NO:32, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:33, and comprises a UAA codon at positions corresponding to positions 3,627-3,629 according to SEQ ID NO:33, or the complement thereof. In some embodiments, the isolated mRNA molecules comprise or consist of a nucleotide sequence that has at least about 90% sequence identity to SEQ ID NO:33, and comprises a UAA codon at positions corresponding to positions 3,627-3,629 according to SEQ ID NO:33, or the complement thereof. In some embodiments, the isolated mRNA molecules comprise or consist of a nucleotide sequence that has at least about 92% sequence identity to SEQ ID NO:33, and comprises a UAA codon at positions corresponding to positions 3,627-3,629 according to SEQ ID NO:33, or the complement thereof. In some embodiments, the isolated mRNA molecules comprise or consist of a nucleotide sequence that has at least about 94% sequence identity to SEQ ID NO:33, and comprises a UAA codon at positions corresponding to positions 3,627-3,629 according to SEQ ID NO:33, or the complement thereof. In some embodiments, the isolated mRNA molecules comprise or consist of a nucleotide sequence that has at least about 96% sequence identity to SEQ ID NO:33, and comprises a UAA codon at positions corresponding to positions 3,627-3,629 according to SEQ ID NO:33, or the complement thereof. In some embodiments, the isolated mRNA molecules comprise or consist of a nucleotide sequence that has at least about 98% sequence identity to SEQ ID NO:33, and comprises a UAA codon at positions corresponding to positions 3,627-3,629 according to SEQ ID NO:33, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:34, and comprises a UAA codon at positions corresponding to positions 4,240-4,242 according to SEQ ID NO:34, or the complement thereof. In some embodiments, the isolated mRNA molecules comprise or consist of a nucleotide sequence that has at least about 90% sequence identity to SEQ ID NO:34, and comprises a UAA codon at positions corresponding to positions 4,240-4,242 according to SEQ ID NO:34, or the complement thereof. In some embodiments, the isolated mRNA molecules comprise or consist of a nucleotide sequence that has at least about 92% sequence identity to SEQ ID NO:34, and comprises a UAA codon at positions corresponding to positions 4,240-4,242 according to SEQ ID NO:34, or the complement thereof. In some embodiments, the isolated mRNA molecules comprise or consist of a nucleotide sequence that has at least about 94% sequence identity to SEQ ID NO:34, and comprises a UAA codon at positions corresponding to positions 4,240-4,242 according to SEQ ID NO:34, or the complement thereof. In some embodiments, the isolated mRNA molecules comprise or consist of a nucleotide sequence that has at least about 96% sequence identity to SEQ ID NO:34, and comprises a UAA codon at positions corresponding to positions 4,240-4,242 according to SEQ ID NO:34, or the complement thereof. In some embodiments, the isolated mRNA molecules comprise or consist of a nucleotide sequence that has at least about 98% sequence identity to SEQ ID NO:34, and comprises a UAA codon at positions corresponding to positions 4,240-4,242 according to SEQ ID NO:34, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:35, and comprises a UAA codon at positions corresponding to positions 3,594-3,596 according to SEQ ID NO:35, or the complement thereof. In some embodiments, the isolated mRNA molecules comprise or consist of a nucleotide sequence that has at least about 90% sequence identity to SEQ ID NO:35, and comprises a UAA codon at positions corresponding to positions 3,594-3,596 according to SEQ ID NO:35, or the complement thereof. In some embodiments, the isolated mRNA molecules comprise or consist of a nucleotide sequence that has at least about 92% sequence identity to SEQ ID NO:35, and comprises a UAA codon at positions corresponding to positions 3,594-3,596 according to SEQ ID NO:35, or the complement thereof. In some embodiments, the isolated mRNA molecules comprise or consist of a nucleotide sequence that has at least about 94% sequence identity to SEQ ID NO:35, and comprises a UAA codon at positions corresponding to positions 3,594-3,596 according to SEQ ID NO:35, or the complement thereof. In some embodiments, the isolated mRNA molecules comprise or consist of a nucleotide sequence that has at least about 96% sequence identity to SEQ ID NO:35, and comprises a UAA codon at positions corresponding to positions 3,594-3,596 according to SEQ ID NO:35, or the complement thereof. In some embodiments, the isolated mRNA molecules comprise or consist of a nucleotide sequence that has at least about 98% sequence identity to SEQ ID NO:35, and comprises a UAA codon at positions corresponding to positions 3,594-3,596 according to SEQ ID NO:35, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:36, and comprises a UAA codon at positions corresponding to positions 3,473-3,475 according to SEQ ID NO:36, or the complement thereof. In some embodiments, the isolated mRNA molecules comprise or consist of a nucleotide sequence that has at least about 90% sequence identity to SEQ ID NO:36, and comprises a UAA codon at positions corresponding to positions 3,473-3,475 according to SEQ ID NO:36, or the complement thereof. In some embodiments, the isolated mRNA molecules comprise or consist of a nucleotide sequence that has at least about 92% sequence identity to SEQ ID NO:36, and comprises a UAA codon at positions corresponding to positions 3,473-3,475 according to SEQ ID NO:36, or the complement thereof. In some embodiments, the isolated mRNA molecules comprise or consist of a nucleotide sequence that has at least about 94% sequence identity to SEQ ID NO:36, and comprises a UAA codon at positions corresponding to positions 3,473-3,475 according to SEQ ID NO:36, or the complement thereof. In some embodiments, the isolated mRNA molecules comprise or consist of a nucleotide sequence that has at least about 96% sequence identity to SEQ ID NO:36, and comprises a UAA codon at positions corresponding to positions 3,473-3,475 according to SEQ ID NO:36, or the complement thereof. In some embodiments, the isolated mRNA molecules comprise or consist of a nucleotide sequence that has at least about 98% sequence identity to SEQ ID NO:36, and comprises a UAA codon at positions corresponding to positions 3,473-3,475 according to SEQ ID NO:36, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:37, and comprises a UAA codon at positions corresponding to positions 3,602-3,604 according to SEQ ID NO:37, or the complement thereof. In some embodiments, the isolated mRNA molecules comprise or consist of a nucleotide sequence that has at least about 90% sequence identity to SEQ ID NO:37, and comprises a UAA codon at positions corresponding to positions 3,602-3,604 according to SEQ ID NO:37, or the complement thereof. In some embodiments, the isolated mRNA molecules comprise or consist of a nucleotide sequence that has at least about 92% sequence identity to SEQ ID NO:37, and comprises a UAA codon at positions corresponding to positions 3,602-3,604 according to SEQ ID NO:37, or the complement thereof. In some embodiments, the isolated mRNA molecules comprise or consist of a nucleotide sequence that has at least about 94% sequence identity to SEQ ID NO:37, and comprises a UAA codon at positions corresponding to positions 3,602-3,604 according to SEQ ID NO:37, or the complement thereof. In some embodiments, the isolated mRNA molecules comprise or consist of a nucleotide sequence that has at least about 96% sequence identity to SEQ ID NO:37, and comprises a UAA codon at positions corresponding to positions 3,602-3,604 according to SEQ ID NO:37, or the complement thereof. In some embodiments, the isolated mRNA molecules comprise or consist of a nucleotide sequence that has at least about 98% sequence identity to SEQ ID NO:37, and comprises a UAA codon at positions corresponding to positions 3,602-3,604 according to SEQ ID NO:37, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:38, and comprises a UAA codon at positions corresponding to positions 3,163-3,165 according to SEQ ID NO:38, or the complement thereof. In some embodiments, the isolated mRNA molecules comprise or consist of a nucleotide sequence that has at least about 90% sequence identity to SEQ ID NO:38, and comprises a UAA codon at positions corresponding to positions 3,163-3,165 according to SEQ ID NO:38, or the complement thereof. In some embodiments, the isolated mRNA molecules comprise or consist of a nucleotide sequence that has at least about 92% sequence identity to SEQ ID NO:38, and comprises a UAA codon at positions corresponding to positions 3,163-3,165 according to SEQ ID NO:38, or the complement thereof. In some embodiments, the isolated mRNA molecules comprise or consist of a nucleotide sequence that has at least about 94% sequence identity to SEQ ID NO:38, and comprises a UAA codon at positions corresponding to positions 3,163-3,165 according to SEQ ID NO:38, or the complement thereof. In some embodiments, the isolated mRNA molecules comprise or consist of a nucleotide sequence that has at least about 96% sequence identity to SEQ ID NO:38, and comprises a UAA codon at positions corresponding to positions 3,163-3,165 according to SEQ ID NO:38, or the complement thereof. In some embodiments, the isolated mRNA molecules comprise or consist of a nucleotide sequence that has at least about 98% sequence identity to SEQ ID NO:38, and comprises a UAA codon at positions corresponding to positions 3,163-3,165 according to SEQ ID NO:38, or the complement thereof.

Herein, if reference is made to percent sequence identity, the higher percentages of sequence identity are preferred over the lower ones.

In some embodiments, the isolated mRNA molecules comprise SEQ ID NO:31. In some embodiments, the isolated mRNA molecules consist of SEQ ID NO:31. In some embodiments, the isolated mRNA molecules comprise SEQ ID NO:32. In some embodiments, the isolated mRNA molecules consist of SEQ ID NO:32. In some embodiments, the isolated mRNA molecules comprise SEQ ID NO:33. In some embodiments, the isolated mRNA molecules consist of SEQ ID NO:33. In some embodiments, the isolated mRNA molecules comprise SEQ ID NO:34. In some embodiments, the isolated mRNA molecules consist of SEQ ID NO:34. In some embodiments, the isolated mRNA molecules comprise SEQ ID NO:35. In some embodiments, the isolated mRNA molecules consist of SEQ ID NO:35. In some embodiments, the isolated mRNA molecules comprise SEQ ID NO:36. In some embodiments, the isolated mRNA molecules consist of SEQ ID NO:36. In some embodiments, the isolated mRNA molecules comprise SEQ ID NO:37. In some embodiments, the isolated mRNA molecules consist of SEQ ID NO:37. In some embodiments, the isolated mRNA molecules comprise SEQ ID NO:38. In some embodiments, the isolated mRNA molecules consist of SEQ ID NO:38.

The nucleotide sequence of an ARHGEF12 reference cDNA molecule is set forth in SEQ ID NO:39. Referring to SEQ ID NO:39, position 3,749 is an adenine. Referring to SEQ ID NO:39, position 4,748 is an adenine. Referring to SEQ ID NO:39, position 4,297 is a guanine.

The nucleotide sequence of another ARHGEF12 reference cDNA molecule is set forth in SEQ ID NO:40. Referring to SEQ ID NO:40, position 3,191 is an adenine. Referring to SEQ ID NO:40, position 4,190 is an adenine. Referring to SEQ ID NO:40, position 3,739 is a guanine.

The nucleotide sequence of another ARHGEF12 reference cDNA molecule is set forth in SEQ ID NO:41. Referring to SEQ ID NO:41, position 3,079 is an adenine. Referring to SEQ ID NO:41, position 4,078 is an adenine. Referring to SEQ ID NO:41, position 3,627 is a guanine.

The nucleotide sequence of another ARHGEF12 reference cDNA molecule is set forth in SEQ ID NO:42. Referring to SEQ ID NO:42, position 3,692 is an adenine. Referring to SEQ ID NO:42, position 4,691 is an adenine. Referring to SEQ ID NO:42, position 4,240 is a guanine.

The nucleotide sequence of another ARHGEF12 reference cDNA molecule is set forth in SEQ ID NO:43. Referring to SEQ ID NO:43, position 3,046 is an adenine. Referring to SEQ ID NO:43, position 4,045 is an adenine. Referring to SEQ ID NO:43, position 3,594 is a guanine.

The nucleotide sequence of another ARHGEF12 reference cDNA molecule is set forth in SEQ ID NO:44. Referring to SEQ ID NO:44, position 2,925 is an adenine. Referring to SEQ ID NO:44, position 3,934 is an adenine. Referring to SEQ ID NO:44, position 3,473 is a guanine.

The nucleotide sequence of another ARHGEF12 reference cDNA molecule is set forth in SEQ ID NO:45. Referring to SEQ ID NO:45, position 3,054 is an adenine. Referring to SEQ ID NO:45, position 3,602 is a guanine.

The nucleotide sequence of another ARHGEF12 reference cDNA molecule is set forth in SEQ ID NO:46. Referring to SEQ ID NO:46, position 2,615 is an adenine. Referring to SEQ ID NO:46, position 3,614 is an adenine. Referring to SEQ ID NO:46, position 3,163 is a guanine.

A variant cDNA molecule of ARHGEF12 exists, wherein the adenine at position 3,749 (referring to SEQ ID NO:39) is replaced with thymine. The nucleotide sequence of this ARHGEF12 variant cDNA molecule is set forth in SEQ ID NO:47.

Another variant cDNA molecule of ARHGEF12 exists, wherein the adenine at position 3,191 (referring to SEQ ID NO:40) is replaced with thymine. The nucleotide sequence of this ARHGEF12 variant cDNA molecule is set forth in SEQ ID NO:48.

Another variant cDNA molecule of ARHGEF12 exists, wherein the adenine at position 3,079 (referring to SEQ ID NO:41) is replaced with thymine. The nucleotide sequence of this ARHGEF12 variant cDNA molecule is set forth in SEQ ID NO:49.

Another variant cDNA molecule of ARHGEF12 exists, wherein the adenine at position 3,692 (referring to SEQ ID NO:42) is replaced with thymine. The nucleotide sequence of this ARHGEF12 variant cDNA molecule is set forth in SEQ ID NO:50.

Another variant cDNA molecule of ARHGEF12 exists, wherein the adenine at position 3,046 (referring to SEQ ID NO:43) is replaced with thymine. The nucleotide sequence of this ARHGEF12 variant cDNA molecule is set forth in SEQ ID NO:51.

Another variant cDNA molecule of ARHGEF12 exists, wherein the adenine at position 2,925 (referring to SEQ ID NO:44) is replaced with thymine. The nucleotide sequence of this ARHGEF12 variant cDNA molecule is set forth in SEQ ID NO:52.

Another variant cDNA molecule of ARHGEF12 exists, wherein the adenine at position 3,054 (referring to SEQ ID NO:45) is replaced with thymine. The nucleotide sequence of this ARHGEF12 variant cDNA molecule is set forth in SEQ ID NO:53.

Another variant cDNA molecule of ARHGEF12 exists, wherein the adenine at position 2,615 (referring to SEQ ID NO:46) is replaced with thymine. The nucleotide sequence of this ARHGEF12 variant cDNA molecule is set forth in SEQ ID NO:54.

A variant cDNA molecule of ARHGEF12 exists, wherein the adenine at position 4,748 (referring to SEQ ID NO:39) is replaced with guanine. The nucleotide sequence of this ARHGEF12 variant cDNA molecule is set forth in SEQ ID NO:55.

Another variant cDNA molecule of ARHGEF12 exists, wherein the adenine at position 4,190 (referring to SEQ ID NO:40) is replaced with guanine. The nucleotide sequence of this ARHGEF12 variant cDNA molecule is set forth in SEQ ID NO:56.

Another variant cDNA molecule of ARHGEF12 exists, wherein the adenine at position 4,078 (referring to SEQ ID NO:41) is replaced with guanine. The nucleotide sequence of this ARHGEF12 variant cDNA molecule is set forth in SEQ ID NO:57.

Another variant cDNA molecule of ARHGEF12 exists, wherein the adenine at position 4,691 (referring to SEQ ID NO:42) is replaced with guanine. The nucleotide sequence of this ARHGEF12 variant cDNA molecule is set forth in SEQ ID NO:58.

Another variant cDNA molecule of ARHGEF12 exists, wherein the adenine at position 4,045 (referring to SEQ ID NO:43) is replaced with guanine. The nucleotide sequence of this ARHGEF12 variant cDNA molecule is set forth in SEQ ID NO:59.

Another variant cDNA molecule of ARHGEF12 exists, wherein the adenine at position 3,924 (referring to SEQ ID NO:44) is replaced with guanine. The nucleotide sequence of this ARHGEF12 variant cDNA molecule is set forth in SEQ ID NO:60.

Another variant cDNA molecule of ARHGEF12 exists, wherein the adenine at position 3,614 (referring to SEQ ID NO:45) is replaced with guanine. The nucleotide sequence of this ARHGEF12 variant cDNA molecule is set forth in SEQ ID NO:61.

Another variant cDNA molecule of ARHGEF12 exists, wherein the guanine at position 4,297 (referring to SEQ ID NO:39) is replaced with thymine, and the GAA codon at positions 4,297 to 4,299 according to SEQ ID NO:39 is replaced with a STOP codon TAA. The nucleotide sequence of this ARHGEF12 variant cDNA molecule is set forth in SEQ ID NO:62.

Another variant cDNA molecule of ARHGEF12 exists, wherein the guanine at position 3,739 (referring to SEQ ID NO:40) is replaced with thymine, and the GAA codon at positions 3,739 to 3,741 according to SEQ ID NO:40 is replaced with a STOP codon TAA. The nucleotide sequence of this ARHGEF12 variant cDNA molecule is set forth in SEQ ID NO:63.

Another variant cDNA molecule of ARHGEF12 exists, wherein the guanine at position 3,627 (referring to SEQ ID NO:41) is replaced with thymine, and the GAA codon at positions 3,627 to 3,629 according to SEQ ID NO:41 is replaced with a STOP codon TAA. The nucleotide sequence of this ARHGEF12 variant cDNA molecule is set forth in SEQ ID NO:64.

Another variant cDNA molecule of ARHGEF12 exists, wherein the guanine at position 4,240 (referring to SEQ ID NO:42) is replaced with thymine, and the GAA codon at positions 4,240 to 4,242 according to SEQ ID NO:42 is replaced with a STOP codon TAA. The nucleotide sequence of this ARHGEF12 variant cDNA molecule is set forth in SEQ ID NO:65.

Another variant cDNA molecule of ARHGEF12 exists, wherein the guanine at position 3,594 (referring to SEQ ID NO:43) is replaced with thymine, and the GAA codon at positions 3,594 to 3,596 according to SEQ ID NO:43 is replaced with a STOP codon TAA. The nucleotide sequence of this ARHGEF12 variant cDNA molecule is set forth in SEQ ID NO:66.

Another variant cDNA molecule of ARHGEF12 exists, wherein the guanine at position 3,473 (referring to SEQ ID NO:44) is replaced with thymine, and the GAA codon at positions 3,473 to 3,475 according to SEQ ID NO:44 is replaced with a STOP codon TAA. The nucleotide sequence of this ARHGEF12 variant cDNA molecule is set forth in SEQ ID NO:67.

Another variant cDNA molecule of ARHGEF12 exists, wherein the guanine at position 3,602 (referring to SEQ ID NO:45) is replaced with thymine, and the GAA codon at positions 3,602 to 3,604 according to SEQ ID NO:45 is replaced with a STOP codon TAA. The nucleotide sequence of this ARHGEF12 variant cDNA molecule is set forth in SEQ ID NO:68.

Another variant cDNA molecule of ARHGEF12 exists, wherein the guanine at position 3,163 (referring to SEQ ID NO:46) is replaced with thymine, and the GAA codon at positions 3,163 to 3,165 according to SEQ ID NO:46 is replaced with a STOP codon TAA. The nucleotide sequence of this ARHGEF12 variant cDNA molecule is set forth in SEQ ID NO:69.

The present disclosure also provides isolated cDNA molecules comprising or consisting of a nucleotide sequence encoding a human ARHGEF12 polypeptide, wherein the nucleotide sequence comprises a thymine at a position corresponding to position 4,297 according to SEQ ID NO:62, or the complement thereof. In some embodiments, the isolated cDNA molecule comprises or consists of a nucleotide sequence encoding a human ARHGEF12 polypeptide, wherein the nucleotide sequence comprises a TAA codon at positions corresponding to positions 4,297-4,299 according to SEQ ID NO:62.

The present disclosure also provides isolated cDNA molecules comprising or consisting of a nucleotide sequence encoding a human ARHGEF12 polypeptide, wherein the nucleotide sequence comprises a thymine at a position corresponding to position 3,379 according to SEQ ID NO:63, or the complement thereof. In some embodiments, the isolated cDNA molecule comprises or consists of a nucleotide sequence encoding a human ARHGEF12 polypeptide, wherein the nucleotide sequence comprises a TAA codon at positions corresponding to positions 3,739-3,741 according to SEQ ID NO:63.

The present disclosure also provides isolated cDNA molecules comprising or consisting of a nucleotide sequence encoding a human ARHGEF12 polypeptide, wherein the nucleotide sequence comprises a thymine at a position corresponding to position 3,627 according to SEQ ID NO:64, or the complement thereof. In some embodiments, the isolated cDNA molecule comprises or consists of a nucleotide sequence encoding a human ARHGEF12 polypeptide, wherein the nucleotide sequence comprises a TAA codon at positions corresponding to positions 3,627-3,629 according to SEQ ID NO:64.

The present disclosure also provides isolated cDNA molecules comprising or consisting of a nucleotide sequence encoding a human ARHGEF12 polypeptide, wherein the nucleotide sequence comprises a thymine at a position corresponding to position 4,240 according to SEQ ID NO:65, or the complement thereof. In some embodiments, the isolated cDNA molecule comprises or consists of a nucleotide sequence encoding a human ARHGEF12 polypeptide, wherein the nucleotide sequence comprises a TAA codon at positions corresponding to positions 4,240-4,242 according to SEQ ID NO:65.

The present disclosure also provides isolated cDNA molecules comprising or consisting of a nucleotide sequence encoding a human ARHGEF12 polypeptide, wherein the nucleotide sequence comprises a thymine at a position corresponding to position 3,594 according to SEQ ID NO:66, or the complement thereof. In some embodiments, the isolated cDNA molecule comprises or consists of a nucleotide sequence encoding a human ARHGEF12 polypeptide, wherein the nucleotide sequence comprises a TAA codon at positions corresponding to positions 3,594-3,596 according to SEQ ID NO:66.

The present disclosure also provides isolated cDNA molecules comprising or consisting of a nucleotide sequence encoding a human ARHGEF12 polypeptide, wherein the nucleotide sequence comprises a thymine at a position corresponding to position 3,473 according to SEQ ID NO:67, or the complement thereof. In some embodiments, the isolated cDNA molecule comprises or consists of a nucleotide sequence encoding a human ARHGEF12 polypeptide, wherein the nucleotide sequence comprises a TAA codon at positions corresponding to positions 3,473-3,475 according to SEQ ID NO:67.

The present disclosure also provides isolated cDNA molecules comprising or consisting of a nucleotide sequence encoding a human ARHGEF12 polypeptide, wherein the nucleotide sequence comprises a thymine at a position corresponding to position 3,602 according to SEQ ID NO:68, or the complement thereof. In some embodiments, the isolated cDNA molecule comprises or consists of a nucleotide sequence encoding a human ARHGEF12 polypeptide, wherein the nucleotide sequence comprises a TAA codon at positions corresponding to positions 3,602-3,604 according to SEQ ID NO:68.

The present disclosure also provides isolated cDNA molecules comprising or consisting of a nucleotide sequence encoding a human ARHGEF12 polypeptide, wherein the nucleotide sequence comprises a thymine at a position corresponding to position 3,163 according to SEQ ID NO:69, or the complement thereof. In some embodiments, the isolated cDNA molecule comprises or consists of a nucleotide sequence encoding a human ARHGEF12 polypeptide, wherein the nucleotide sequence comprises a TAA codon at positions corresponding to positions 3,163-3,165 according to SEQ ID NO:69.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:62, and comprises a thymine at a position corresponding to position 4,297 according to SEQ ID NO:62, or the complement thereof. In some embodiments, the isolated cDNA molecules comprise or consist of a nucleotide sequence that has at least about 90% sequence identity to SEQ ID NO:62, and comprises a thymine at a position corresponding to position 4,297 according to SEQ ID NO:62, or the complement thereof. In some embodiments, the isolated cDNA molecules comprise or consist of a nucleotide sequence that has at least about 92% sequence identity to SEQ ID NO:62, and comprises a thymine at a position corresponding to position 4,297 according to SEQ ID NO:62, or the complement thereof. In some embodiments, the isolated cDNA molecules comprise or consist of a nucleotide sequence that has at least about 94% sequence identity to SEQ ID NO:62, and comprises a thymine at a position corresponding to position 4,297 according to SEQ ID NO:62, or the complement thereof. In some embodiments, the isolated cDNA molecules comprise or consist of a nucleotide sequence that has at least about 96% sequence identity to SEQ ID NO:62, and comprises a thymine at a position corresponding to position 4,297 according to SEQ ID NO:62, or the complement thereof. In some embodiments, the isolated cDNA molecules comprise or consist of a nucleotide sequence that has at least about 98% sequence identity to SEQ ID NO:62, and comprises a thymine at a position corresponding to position 4,297 according to SEQ ID NO:62, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:63, and comprises a thymine at a position corresponding to position 3,379 according to SEQ ID NO:63, or the complement thereof. In some embodiments, the isolated cDNA molecules comprise or consist of a nucleotide sequence that has at least about 90% sequence identity to SEQ ID NO:63, and comprises a thymine at a position corresponding to position 3,379 according to SEQ ID NO:63, or the complement thereof. In some embodiments, the isolated cDNA molecules comprise or consist of a nucleotide sequence that has at least about 92% sequence identity to SEQ ID NO:63, and comprises a thymine at a position corresponding to position 3,379 according to SEQ ID NO:63, or the complement thereof. In some embodiments, the isolated cDNA molecules comprise or consist of a nucleotide sequence that has at least about 94% sequence identity to SEQ ID NO:63, and comprises a thymine at a position corresponding to position 3,379 according to SEQ ID NO:63, or the complement thereof. In some embodiments, the isolated cDNA molecules comprise or consist of a nucleotide sequence that has at least about 96% sequence identity to SEQ ID NO:63, and comprises a thymine at a position corresponding to position 3,379 according to SEQ ID NO:63, or the complement thereof. In some embodiments, the isolated cDNA molecules comprise or consist of a nucleotide sequence that has at least about 98% sequence identity to SEQ ID NO:63, and comprises a thymine at a position corresponding to position 3,379 according to SEQ ID NO:63, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:64, and comprises a thymine at a position corresponding to position 3,627 according to SEQ ID NO:64, or the complement thereof. In some embodiments, the isolated cDNA molecules comprise or consist of a nucleotide sequence that has at least about 90% sequence identity to SEQ ID NO:64, and comprises a thymine at a position corresponding to position 3,627 according to SEQ ID NO:64, or the complement thereof. In some embodiments, the isolated cDNA molecules comprise or consist of a nucleotide sequence that has at least about 92% sequence identity to SEQ ID NO:64, and comprises a thymine at a position corresponding to position 3,627 according to SEQ ID NO:64, or the complement thereof. In some embodiments, the isolated cDNA molecules comprise or consist of a nucleotide sequence that has at least about 94% sequence identity to SEQ ID NO:64, and comprises a thymine at a position corresponding to position 3,627 according to SEQ ID NO:64, or the complement thereof. In some embodiments, the isolated cDNA molecules comprise or consist of a nucleotide sequence that has at least about 96% sequence identity to SEQ ID NO:64, and comprises a thymine at a position corresponding to position 3,627 according to SEQ ID NO:64, or the complement thereof. In some embodiments, the isolated cDNA molecules comprise or consist of a nucleotide sequence that has at least about 98% sequence identity to SEQ ID NO:64, and comprises a thymine at a position corresponding to position 3,627 according to SEQ ID NO:64, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:65, and comprises a thymine at a position corresponding to position 4,240 according to SEQ ID NO:65, or the complement thereof. In some embodiments, the isolated cDNA molecules comprise or consist of a nucleotide sequence that has at least about 90% sequence identity to SEQ ID NO:65, and comprises a thymine at a position corresponding to position 4,240 according to SEQ ID NO:65, or the complement thereof. In some embodiments, the isolated cDNA molecules comprise or consist of a nucleotide sequence that has at least about 92% sequence identity to SEQ ID NO:65, and comprises a thymine at a position corresponding to position 4,240 according to SEQ ID NO:65, or the complement thereof. In some embodiments, the isolated cDNA molecules comprise or consist of a nucleotide sequence that has at least about 94% sequence identity to SEQ ID NO:65, and comprises a thymine at a position corresponding to position 4,240 according to SEQ ID NO:65, or the complement thereof. In some embodiments, the isolated cDNA molecules comprise or consist of a nucleotide sequence that has at least about 96% sequence identity to SEQ ID NO:65, and comprises a thymine at a position corresponding to position 4,240 according to SEQ ID NO:65, or the complement thereof. In some embodiments, the isolated cDNA molecules comprise or consist of a nucleotide sequence that has at least about 98% sequence identity to SEQ ID NO:65, and comprises a thymine at a position corresponding to position 4,240 according to SEQ ID NO:65, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:66, and comprises a thymine at a position corresponding to position 3,594 according to SEQ ID NO:66, or the complement thereof. In some embodiments, the isolated cDNA molecules comprise or consist of a nucleotide sequence that has at least about 90% sequence identity to SEQ ID NO:66, and comprises a thymine at a position corresponding to position 3,594 according to SEQ ID NO:66, or the complement thereof. In some embodiments, the isolated cDNA molecules comprise or consist of a nucleotide sequence that has at least about 92% sequence identity to SEQ ID NO:66, and comprises a thymine at a position corresponding to position 3,594 according to SEQ ID NO:66, or the complement thereof. In some embodiments, the isolated cDNA molecules comprise or consist of a nucleotide sequence that has at least about 94% sequence identity to SEQ ID NO:66, and comprises a thymine at a position corresponding to position 3,594 according to SEQ ID NO:66, or the complement thereof. In some embodiments, the isolated cDNA molecules comprise or consist of a nucleotide sequence that has at least about 96% sequence identity to SEQ ID NO:66, and comprises a thymine at a position corresponding to position 3,594 according to SEQ ID NO:66, or the complement thereof. In some embodiments, the isolated cDNA molecules comprise or consist of a nucleotide sequence that has at least about 98% sequence identity to SEQ ID NO:66, and comprises a thymine at a position corresponding to position 3,594 according to SEQ ID NO:66, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:67, and comprises a thymine at a position corresponding to position 3,473 according to SEQ ID NO:67, or the complement thereof. In some embodiments, the isolated cDNA molecules comprise or consist of a nucleotide sequence that has at least about 90% sequence identity to SEQ ID NO:67, and comprises a thymine at a position corresponding to position 3,473 according to SEQ ID NO:67, or the complement thereof. In some embodiments, the isolated cDNA molecules comprise or consist of a nucleotide sequence that has at least about 92% sequence identity to SEQ ID NO:67, and comprises a thymine at a position corresponding to position 3,473 according to SEQ ID NO:67, or the complement thereof. In some embodiments, the isolated cDNA molecules comprise or consist of a nucleotide sequence that has at least about 94% sequence identity to SEQ ID NO:67, and comprises a thymine at a position corresponding to position 3,473 according to SEQ ID NO:67, or the complement thereof. In some embodiments, the isolated cDNA molecules comprise or consist of a nucleotide sequence that has at least about 96% sequence identity to SEQ ID NO:67, and comprises a thymine at a position corresponding to position 3,473 according to SEQ ID NO:67, or the complement thereof. In some embodiments, the isolated cDNA molecules comprise or consist of a nucleotide sequence that has at least about 98% sequence identity to SEQ ID NO:67, and comprises a thymine at a position corresponding to position 3,473 according to SEQ ID NO:67, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:68, and comprises a thymine at a position corresponding to position 3,602 according to SEQ ID NO:68, or the complement thereof. In some embodiments, the isolated cDNA molecules comprise or consist of a nucleotide sequence that has at least about 90% sequence identity to SEQ ID NO:68, and comprises a thymine at a position corresponding to position 3,602 according to SEQ ID NO:68, or the complement thereof. In some embodiments, the isolated cDNA molecules comprise or consist of a nucleotide sequence that has at least about 92% sequence identity to SEQ ID NO:68, and comprises a thymine at a position corresponding to position 3,602 according to SEQ ID NO:68, or the complement thereof. In some embodiments, the isolated cDNA molecules comprise or consist of a nucleotide sequence that has at least about 94% sequence identity to SEQ ID NO:68, and comprises a thymine at a position corresponding to position 3,602 according to SEQ ID NO:68, or the complement thereof. In some embodiments, the isolated cDNA molecules comprise or consist of a nucleotide sequence that has at least about 96% sequence identity to SEQ ID NO:68, and comprises a thymine at a position corresponding to position 3,602 according to SEQ ID NO:68, or the complement thereof. In some embodiments, the isolated cDNA molecules comprise or consist of a nucleotide sequence that has at least about 98% sequence identity to SEQ ID NO:68, and comprises a thymine at a position corresponding to position 3,602 according to SEQ ID NO:68, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:69, and comprises a thymine at a position corresponding to position 3,163 according to SEQ ID NO:69, or the complement thereof. In some embodiments, the isolated cDNA molecules comprise or consist of a nucleotide sequence that has at least about 90% sequence identity to SEQ ID NO:69, and comprises a thymine at a position corresponding to position 3,163 according to SEQ ID NO:69, or the complement thereof. In some embodiments, the isolated cDNA molecules comprise or consist of a nucleotide sequence that has at least about 92% sequence identity to SEQ ID NO:69, and comprises a thymine at a position corresponding to position 3,163 according to SEQ ID NO:69, or the complement thereof. In some embodiments, the isolated cDNA molecules comprise or consist of a nucleotide sequence that has at least about 94% sequence identity to SEQ ID NO:69, and comprises a thymine at a position corresponding to position 3,163 according to SEQ ID NO:69, or the complement thereof. In some embodiments, the isolated cDNA molecules comprise or consist of a nucleotide sequence that has at least about 96% sequence identity to SEQ ID NO:69, and comprises a thymine at a position corresponding to position 3,163 according to SEQ ID NO:69, or the complement thereof. In some embodiments, the isolated cDNA molecules comprise or consist of a nucleotide sequence that has at least about 98% sequence identity to SEQ ID NO:69, and comprises a thymine at a position corresponding to position 3,163 according to SEQ ID NO:69, or the complement thereof.

Herein, if reference is made to percent sequence identity, the higher percentages of sequence identity are preferred over the lower ones.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:62, and comprises a TAA codon at positions corresponding to positions 4,297-4,299 according to SEQ ID NO:62, or the complement thereof. In some embodiments, the isolated cDNA molecules comprise or consist of a nucleotide sequence that has at least about 90% sequence identity to SEQ ID NO:62, and comprises a TAA codon at positions corresponding to positions 4,297-4,299 according to SEQ ID NO:62, or the complement thereof. In some embodiments, the isolated cDNA molecules comprise or consist of a nucleotide sequence that has at least about 92% sequence identity to SEQ ID NO:62, and comprises a TAA codon at positions corresponding to positions 4,297-4,299 according to SEQ ID NO:62, or the complement thereof. In some embodiments, the isolated cDNA molecules comprise or consist of a nucleotide sequence that has at least about 94% sequence identity to SEQ ID NO:62, and comprises a TAA codon at positions corresponding to positions 4,297-4,299 according to SEQ ID NO:62, or the complement thereof. In some embodiments, the isolated cDNA molecules comprise or consist of a nucleotide sequence that has at least about 96% sequence identity to SEQ ID NO:62, and comprises a TAA codon at positions corresponding to positions 4,297-4,299 according to SEQ ID NO:62, or the complement thereof. In some embodiments, the isolated cDNA molecules comprise or consist of a nucleotide sequence that has at least about 98% sequence identity to SEQ ID NO:62, and comprises a TAA codon at positions corresponding to positions 4,297-4,299 according to SEQ ID NO:62, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:63, and comprises a TAA codon at positions corresponding to positions 3,739-3,741 according to SEQ ID NO:63, or the complement thereof. In some embodiments, the isolated cDNA molecules comprise or consist of a nucleotide sequence that has at least about 90% sequence identity to SEQ ID NO:63, and comprises a TAA codon at positions corresponding to positions 3,739-3,741 according to SEQ ID NO:63, or the complement thereof. In some embodiments, the isolated cDNA molecules comprise or consist of a nucleotide sequence that has at least about 92% sequence identity to SEQ ID NO:63, and comprises a TAA codon at positions corresponding to positions 3,739-3,741 according to SEQ ID NO:63, or the complement thereof. In some embodiments, the isolated cDNA molecules comprise or consist of a nucleotide sequence that has at least about 94% sequence identity to SEQ ID NO:63, and comprises a TAA codon at positions corresponding to positions 3,739-3,741 according to SEQ ID NO:63, or the complement thereof. In some embodiments, the isolated cDNA molecules comprise or consist of a nucleotide sequence that has at least about 96% sequence identity to SEQ ID NO:63, and comprises a TAA codon at positions corresponding to positions 3,739-3,741 according to SEQ ID NO:63, or the complement thereof. In some embodiments, the isolated cDNA molecules comprise or consist of a nucleotide sequence that has at least about 98% sequence identity to SEQ ID NO:63, and comprises a TAA codon at positions corresponding to positions 3,739-3,741 according to SEQ ID NO:63, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:64, and comprises a TAA codon at positions corresponding to positions 3,627-3,629 according to SEQ ID NO:64, or the complement thereof. In some embodiments, the isolated cDNA molecules comprise or consist of a nucleotide sequence that has at least about 90% sequence identity to SEQ ID NO:64, and comprises a TAA codon at positions corresponding to positions 3,627-3,629 according to SEQ ID NO:64, or the complement thereof. In some embodiments, the isolated cDNA molecules comprise or consist of a nucleotide sequence that has at least about 92% sequence identity to SEQ ID NO:64, and comprises a TAA codon at positions corresponding to positions 3,627-3,629 according to SEQ ID NO:64, or the complement thereof. In some embodiments, the isolated cDNA molecules comprise or consist of a nucleotide sequence that has at least about 94% sequence identity to SEQ ID NO:64, and comprises a TAA codon at positions corresponding to positions 3,627-3,629 according to SEQ ID NO:64, or the complement thereof. In some embodiments, the isolated cDNA molecules comprise or consist of a nucleotide sequence that has at least about 96% sequence identity to SEQ ID NO:64, and comprises a TAA codon at positions corresponding to positions 3,627-3,629 according to SEQ ID NO:64, or the complement thereof. In some embodiments, the isolated cDNA molecules comprise or consist of a nucleotide sequence that has at least about 98% sequence identity to SEQ ID NO:64, and comprises a TAA codon at positions corresponding to positions 3,627-3,629 according to SEQ ID NO:64, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:65, and comprises a TAA codon at positions corresponding to positions 4,240-4,242 according to SEQ ID NO:65, or the complement thereof. In some embodiments, the isolated cDNA molecules comprise or consist of a nucleotide sequence that has at least about 90% sequence identity to SEQ ID NO:65, and comprises a TAA codon at positions corresponding to positions 4,240-4,242 according to SEQ ID NO:65, or the complement thereof. In some embodiments, the isolated cDNA molecules comprise or consist of a nucleotide sequence that has at least about 92% sequence identity to SEQ ID NO:65, and comprises a TAA codon at positions corresponding to positions 4,240-4,242 according to SEQ ID NO:65, or the complement thereof. In some embodiments, the isolated cDNA molecules comprise or consist of a nucleotide sequence that has at least about 94% sequence identity to SEQ ID NO:65, and comprises a TAA codon at positions corresponding to positions 4,240-4,242 according to SEQ ID NO:65, or the complement thereof. In some embodiments, the isolated cDNA molecules comprise or consist of a nucleotide sequence that has at least about 96% sequence identity to SEQ ID NO:65, and comprises a TAA codon at positions corresponding to positions 4,240-4,242 according to SEQ ID NO:65, or the complement thereof. In some embodiments, the isolated cDNA molecules comprise or consist of a nucleotide sequence that has at least about 98% sequence identity to SEQ ID NO:65, and comprises a TAA codon at positions corresponding to positions 4,240-4,242 according to SEQ ID NO:65, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:66, and comprises a TAA codon at positions corresponding to positions 3,594-3,596 according to SEQ ID NO:66, or the complement thereof. In some embodiments, the isolated cDNA molecules comprise or consist of a nucleotide sequence that has at least about 90% sequence identity to SEQ ID NO:66, and comprises a TAA codon at positions corresponding to positions 3,594-3,596 according to SEQ ID NO:66, or the complement thereof. In some embodiments, the isolated cDNA molecules comprise or consist of a nucleotide sequence that has at least about 92% sequence identity to SEQ ID NO:66, and comprises a TAA codon at positions corresponding to positions 3,594-3,596 according to SEQ ID NO:66, or the complement thereof. In some embodiments, the isolated cDNA molecules comprise or consist of a nucleotide sequence that has at least about 94% sequence identity to SEQ ID NO:66, and comprises a TAA codon at positions corresponding to positions 3,594-3,596 according to SEQ ID NO:66, or the complement thereof. In some embodiments, the isolated cDNA molecules comprise or consist of a nucleotide sequence that has at least about 96% sequence identity to SEQ ID NO:66, and comprises a TAA codon at positions corresponding to positions 3,594-3,596 according to SEQ ID NO:66, or the complement thereof. In some embodiments, the isolated cDNA molecules comprise or consist of a nucleotide sequence that has at least about 98% sequence identity to SEQ ID NO:66, and comprises a TAA codon at positions corresponding to positions 3,594-3,596 according to SEQ ID NO:66, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:67, and comprises a TAA codon at positions corresponding to positions 3,473-3,475 according to SEQ ID NO:67, or the complement thereof. In some embodiments, the isolated cDNA molecules comprise or consist of a nucleotide sequence that has at least about 90% sequence identity to SEQ ID NO:67, and comprises a TAA codon at positions corresponding to positions 3,473-3,475 according to SEQ ID NO:67, or the complement thereof. In some embodiments, the isolated cDNA molecules comprise or consist of a nucleotide sequence that has at least about 92% sequence identity to SEQ ID NO:67, and comprises a TAA codon at positions corresponding to positions 3,473-3,475 according to SEQ ID NO:67, or the complement thereof. In some embodiments, the isolated cDNA molecules comprise or consist of a nucleotide sequence that has at least about 94% sequence identity to SEQ ID NO:67, and comprises a TAA codon at positions corresponding to positions 3,473-3,475 according to SEQ ID NO:67, or the complement thereof. In some embodiments, the isolated cDNA molecules comprise or consist of a nucleotide sequence that has at least about 96% sequence identity to SEQ ID NO:67, and comprises a TAA codon at positions corresponding to positions 3,473-3,475 according to SEQ ID NO:67, or the complement thereof. In some embodiments, the isolated cDNA molecules comprise or consist of a nucleotide sequence that has at least about 98% sequence identity to SEQ ID NO:67, and comprises a TAA codon at positions corresponding to positions 3,473-3,475 according to SEQ ID NO:67, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:68, and comprises a TAA codon at positions corresponding to positions 3,602-3,604 according to SEQ ID NO:68, or the complement thereof. In some embodiments, the isolated cDNA molecules comprise or consist of a nucleotide sequence that has at least about 90% sequence identity to SEQ ID NO:68, and comprises a TAA codon at positions corresponding to positions 3,602-3,604 according to SEQ ID NO:68, or the complement thereof. In some embodiments, the isolated cDNA molecules comprise or consist of a nucleotide sequence that has at least about 92% sequence identity to SEQ ID NO:68, and comprises a TAA codon at positions corresponding to positions 3,602-3,604 according to SEQ ID NO:68, or the complement thereof. In some embodiments, the isolated cDNA molecules comprise or consist of a nucleotide sequence that has at least about 94% sequence identity to SEQ ID NO:68, and comprises a TAA codon at positions corresponding to positions 3,602-3,604 according to SEQ ID NO:68, or the complement thereof. In some embodiments, the isolated cDNA molecules comprise or consist of a nucleotide sequence that has at least about 96% sequence identity to SEQ ID NO:68, and comprises a TAA codon at positions corresponding to positions 3,602-3,604 according to SEQ ID NO:68, or the complement thereof. In some embodiments, the isolated cDNA molecules comprise or consist of a nucleotide sequence that has at least about 98% sequence identity to SEQ ID NO:68, and comprises a TAA codon at positions corresponding to positions 3,602-3,604 according to SEQ ID NO:68, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:69, and comprises a TAA codon at positions corresponding to positions 3,163-3,165 according to SEQ ID NO:69, or the complement thereof. In some embodiments, the isolated cDNA molecules comprise or consist of a nucleotide sequence that has at least about 90% sequence identity to SEQ ID NO:69, and comprises a TAA codon at positions corresponding to positions 3,163-3,165 according to SEQ ID NO:69, or the complement thereof. In some embodiments, the isolated cDNA molecules comprise or consist of a nucleotide sequence that has at least about 92% sequence identity to SEQ ID NO:69, and comprises a TAA codon at positions corresponding to positions 3,163-3,165 according to SEQ ID NO:69, or the complement thereof. In some embodiments, the isolated cDNA molecules comprise or consist of a nucleotide sequence that has at least about 94% sequence identity to SEQ ID NO:69, and comprises a TAA codon at positions corresponding to positions 3,163-3,165 according to SEQ ID NO:69, or the complement thereof. In some embodiments, the isolated cDNA molecules comprise or consist of a nucleotide sequence that has at least about 96% sequence identity to SEQ ID NO:69, and comprises a TAA codon at positions corresponding to positions 3,163-3,165 according to SEQ ID NO:69, or the complement thereof. In some embodiments, the isolated cDNA molecules comprise or consist of a nucleotide sequence that has at least about 98% sequence identity to SEQ ID NO:69, and comprises a TAA codon at positions corresponding to positions 3,163-3,165 according to SEQ ID NO:69, or the complement thereof.

Herein, if reference is made to percent sequence identity, the higher percentages of sequence identity are preferred over the lower ones.

In some embodiments, the isolated cDNA molecules comprise SEQ ID NO:62. In some embodiments, the isolated cDNA molecules consist of SEQ ID NO:62. In some embodiments, the isolated cDNA molecules comprise SEQ ID NO:63. In some embodiments, the isolated cDNA molecules consist of SEQ ID NO:63. In some embodiments, the isolated cDNA molecules comprise SEQ ID NO:64. In some embodiments, the isolated cDNA molecules consist of SEQ ID NO:64. In some embodiments, the isolated cDNA molecules comprise SEQ ID NO:65. In some embodiments, the isolated cDNA molecules consist of SEQ ID NO:65. In some embodiments, the isolated cDNA molecules comprise SEQ ID NO:66. In some embodiments, the isolated cDNA molecules consist of SEQ ID NO:66. In some embodiments, the isolated cDNA molecules comprise SEQ ID NO:67. In some embodiments, the isolated cDNA molecules consist of SEQ ID NO:67. In some embodiments, the isolated cDNA molecules comprise SEQ ID NO:68. In some embodiments, the isolated cDNA molecules consist of SEQ ID NO:68. In some embodiments, the isolated cDNA molecules comprise SEQ ID NO:69. In some embodiments, the isolated cDNA molecules consist of SEQ ID NO:69.

In some embodiments, the isolated mRNA molecules or cDNA molecules comprise less than the entire mRNA or cDNA sequence. In some embodiments, the isolated mRNA molecules or cDNA molecules comprise or consist of at least about 5, at least about 8, at least about 10, at least about 12, at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, at least about 1000, at least about 1100, at least about 1200, at least about 1300, at least about 1400, at least about 1500, at least about 1600, at least about 1700, at least about 1800, at least about 1900, or at least about 2000 contiguous nucleotides of any of the ARHGEF12 mRNA molecules or cDNA molecules disclosed herein. In some embodiments, the isolated mRNA molecules or cDNA molecules comprise or consist of at least about 400 to at least about 500 contiguous nucleotides of any of the ARHGEF12 mRNA molecules or cDNA molecules disclosed herein. In some embodiments, the isolated cDNA molecules comprise or consist of at least about 1000 to at least about 2000 contiguous nucleotides of any of the ARHGEF12 mRNA molecules or cDNA molecules disclosed herein.

In some embodiments, these isolated mRNA molecules comprise a uracil at the position corresponding to position 4,297 according to SEQ ID NO:31, a uracil at the position corresponding to position 3,739 according to SEQ ID NO:32, a uracil at the position corresponding to position 3,627 according to SEQ ID NO:33, a uracil at the position corresponding to position 4,240 according to SEQ ID NO:34, a uracil at the position corresponding to position 3,594 according to SEQ ID NO:35, a uracil at the position corresponding to position 3,473 according to SEQ ID NO:36, a uracil at the position corresponding to position 3,602 according to SEQ ID NO:37, or a uracil at the position corresponding to position 3,163 according to SEQ ID NO:38.

In some embodiments, these isolated cDNA molecules comprise a thymine at the position corresponding to position 4,297 according to SEQ ID NO:62, a thymine at the position corresponding to position 3,379 according to SEQ ID NO:63, a thymine at the position corresponding to position 3,627 according to SEQ ID NO:64, a thymine at the position corresponding to position 4,240 according to SEQ ID NO:65, a thymine at the position corresponding to position 3,594 according to SEQ ID NO:66, a thymine at the position corresponding to position 3,473 according to SEQ ID NO:67, a thymine at the position corresponding to position 3,602 according to SEQ ID NO:68, or a thymine at the position corresponding to position 3,163 according to SEQ ID NO:69.

The genomic nucleic acid molecules, mRNA molecules, and cDNA molecules can be from any organism. For example, the genomic nucleic acid molecules, mRNA molecules, and cDNA molecules can be human or an ortholog from another organism, such as a non-human mammal, a rodent, a mouse, or a rat. It is understood that gene sequences within a population can vary due to polymorphisms such as single-nucleotide polymorphisms. The examples provided herein are only exemplary sequences. Other sequences are also possible.

The present disclosure also provides fragments of any of the isolated genomic nucleic acid molecules, mRNA molecules, or cDNA molecules disclosed herein. In some embodiments, the fragments comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, or at least about 100 contiguous residues of any of the nucleic acid molecules disclosed herein, or any complement thereof. In some embodiments, the fragments comprise or consist of at least about 20, at least about 25, at least about 30, or at least about 35 contiguous residues of any of the nucleic acid molecules disclosed herein, or any complement thereof. In this regard, the longer fragments are preferred over the shorter ones. Such fragments may be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein.

Also provided herein are functional polynucleotides that can interact with the disclosed nucleic acid molecules. Examples of functional polynucleotides include, but are not limited to, antisense molecules, aptamers, ribozymes, triplex forming molecules, and external guide sequences. The functional polynucleotides can act as effectors, inhibitors, modulators, and stimulators of a specific activity possessed by a target molecule, or the functional polynucleotides can possess a de novo activity independent of any other molecules.

The isolated nucleic acid molecules disclosed herein can comprise RNA, DNA, or both RNA and DNA. The isolated nucleic acid molecules can also be linked or fused to a heterologous nucleic acid sequence, such as in a vector, or a heterologous label. For example, the isolated nucleic acid molecules disclosed herein can be within a vector or as an exogenous donor sequence comprising the isolated nucleic acid molecule and a heterologous nucleic acid sequence. The isolated nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$ alkynyl. Exemplary 2' sugar modifications also include, but are not limited to, —O[(CH$_2$)$_n$O]$_m$CH$_3$, —O(CH$_2$)$_n$OCH$_3$, —O(CH$_2$)$_n$NH$_2$, —O(CH$_2$)$_n$CH$_3$, —O(CH$_2$)$_n$—ONH$_2$, and —O(CH$_2$)$_n$ON[(CH$_2$)$_n$CH$_3$)]$_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as CH$_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

In some embodiments, the antisense nucleic acid molecules are gapmers, whereby the first one to seven nucleotides at the 5' and 3' ends each have 2'-methoxyethyl (2'-MOE) modifications. In some embodiments, the first five nucleotides at the 5' and 3' ends each have 2'-MOE modifications. In some embodiments, the first one to seven nucleotides at the 5' and 3' ends are RNA nucleotides. In some embodiments, the first five nucleotides at the 5' and 3' ends are RNA nucleotides. In some embodiments, each of the backbone linkages between the nucleotides is a phosphorothioate linkage.

In some embodiments, the siRNA molecules have termini modifications. In some embodiments, the 5' end of the antisense strand is phosphorylated. In some embodiments, 5'-phosphate analogs that cannot be hydrolyzed, such as 5'-(E)-vinyl-phosphonate are used.

In some embodiments, the siRNA molecules have backbone modifications. In some embodiments, the modified phosphodiester groups that link consecutive ribose nucleosides have been shown to enhance the stability and in vivo bioavailability of siRNAs The non-ester groups (—OH, =O) of the phosphodiester linkage can be replaced with sulfur, boron, or acetate to give phosphorothioate, boranophosphate, and phosphonoacetate linkages. In addition, substituting the phosphodiester group with a phosphotriester can facilitate cellular uptake of siRNAs and retention on serum components by eliminating their negative charge. In some embodiments, the siRNA molecules have sugar modifications. In some embodiments, the sugars are deprotonated (reaction catalyzed by exo- and endonucleases) whereby the 2'-hydroxyl can act as a nucleophile and attack the adjacent phosphorous in the phosphodiester bond. Such alternatives include 2'-O-methyl, 2'-O-methoxyethyl, and 2'-fluoro modifications.

In some embodiments, the siRNA molecules have base modifications. In some embodiments, the bases can be substituted with modified bases such as pseudouridine, 5'-methylcytidine, N6-methyladenosine, inosine, and N7-methylguanosine.

In some embodiments, the siRNA molecules are conjugated to lipids. Lipids can be conjugated to the 5' or 3' termini of siRNA to improve their in vivo bioavailability by allowing them to associate with serum lipoproteins. Representative lipids include, but are not limited to, cholesterol and vitamin E, and fatty acids, such as palmitate and tocopherol.

In some embodiments, a representative siRNA has the following formula:

Sense:mN*mN*/i2FN/mN/i2FN/mN/i2FN/mN/i2FN/
mN/i2FN/mN/i2FN/mN/i2FN/mN/i2FN/*mN*/
32FN/

Antisense:/52FN/*/i2FN/*mN/i2FN/mN/i2FN/mN/
i2FN/mN/i2FN/mN/i2FN/mN/i2FN/mN/i2FN/
mN/i2FN/mN*N*N wherein: "N" is the base; "2F" is a 2'-F modification; "m" is a 2'-O-methyl modification, "I" is an internal base; and "*" is a phosphorothioate backbone linkage.

In any of the embodiments described herein, the inhibitory nucleic acid molecules may be administered, for example, as one to two hour i.v. infusions or s.c. injections. In any of the embodiments described herein, the inhibitory nucleic acid molecules may be administered at dose levels that range from about 50 mg to about 900 mg, from about 100 mg to about 800 mg, from about 150 mg to about 700 mg, or from about 175 to about 640 mg (2.5 to 9.14 mg/kg; 92.5 to 338 mg/m$^2$—based on an assumption of a body weight of 70 kg and a conversion of mg/kg to mg/m$^2$ dose levels based on a mg/kg dose multiplier value of 37 for humans).

The present disclosure also provides vectors comprising any one or more of the nucleic acid molecules disclosed herein. In some embodiments, the vectors comprise any one or more of the nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

Desired regulatory sequences for mammalian host cell expression can include, for example, viral elements that direct high levels of polypeptide expression in mammalian cells, such as promoters and/or enhancers derived from retroviral LTRs, cytomegalovirus (CMV) (such as, for example, CMV promoter/enhancer), Simian Virus 40 (SV40) (such as, for example, SV40 promoter/enhancer), adenovirus, (such as, for example, the adenovirus major late promoter (AdMLP)), polyoma and strong mammalian promoters such as native immunoglobulin and actin promoters. Methods of expressing polypeptides in bacterial cells or fungal cells (such as, for example, yeast cells) are also well known. A promoter can be, for example, a constitutively active promoter, a conditional promoter, an inducible promoter, a temporally restricted promoter (such as, for example, a developmentally regulated promoter), or a spatially restricted promoter (such as, for example, a cell-specific or tissue-specific promoter).

Percent identity (or percent complementarity) between particular stretches of nucleotide sequences within nucleic acid molecules or amino acid sequences within polypeptides can be determined routinely using BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489). Herein, if reference is made to percent sequence identity, the higher percentages of sequence identity are preferred over the lower ones.

The present disclosure also provides compositions comprising any one or more of the isolated nucleic acid molecules, genomic nucleic acid molecules, mRNA molecules, and/or cDNA molecules disclosed herein. In some embodiments, the composition is a pharmaceutical composition. In some embodiments, the compositions comprise a carrier and/or excipient. Examples of carriers include, but are not limited to, poly(lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

As used herein, the phrase "corresponding to" or grammatical variations thereof when used in the context of the numbering of a particular nucleotide or nucleotide sequence or position refers to the numbering of a specified reference sequence when the particular nucleotide or nucleotide sequence is compared to a reference sequence (such as, for example, SEQ ID NO:1, SEQ ID NO:8, or SEQ ID NO:39). In other words, the residue (such as, for example, nucleotide or amino acid) number or residue (such as, for example, nucleotide or amino acid) position of a particular polymer is designated with respect to the reference sequence rather than by the actual numerical position of the residue within the particular nucleotide or nucleotide sequence. For example, a particular nucleotide sequence can be aligned to a reference sequence by introducing gaps to optimize residue matches between the two sequences. In these cases, although the gaps are present, the numbering of the residue in the particular nucleotide or nucleotide sequence is made with respect to the reference sequence to which it has been aligned.

For example, a nucleic acid molecule comprising a nucleotide sequence encoding a human ARHGEF12 polypeptide, wherein the nucleotide sequence comprises a thymine at a position corresponding to position 132,939 according to SEQ ID NO:2 means that if the nucleotide sequence of the ARHGEF12 genomic nucleic acid molecule is aligned to the sequence of SEQ ID NO:2, the ARHGEF12 sequence has a thymine residue at the position that corresponds to position 132,939 of SEQ ID NO:2. The same applies for mRNA molecules comprising a nucleotide sequence encoding a human ARHGEF12 polypeptide, wherein the nucleotide sequence comprises a uracil at a position corresponding to position 3,749 according to SEQ ID NO:16, and cDNA molecules comprising a nucleotide sequence encoding a human ARHGEF12 polypeptide, wherein the nucleotide sequence comprises a thymine at a position corresponding to position 3,749 according to SEQ ID NO:47. In other words, these phrases refer to a nucleic acid molecule encoding an ARHGEF12 polypeptide, wherein the genomic nucleic acid molecule has a nucleotide sequence that comprises a thymine residue that is homologous to the thymine residue at position 132,939 of SEQ ID NO:2 (or wherein the mRNA molecule has a nucleotide sequence that comprises a uracil residue that is homologous to the uracil residue at position 3,749 of SEQ ID NO:16, or wherein the cDNA molecule has a nucleotide sequence that comprises a thymine residue that is homologous to the thymine residue at position 3,749 of SEQ ID NO:47). Herein, such a sequence is also referred to as "ARHGEF12 sequence with the Tyr973Phe alteration" or "ARHGEF12 sequence with the Tyr973Phe variation" referring to genomic nucleic acid molecules (or "ARHGEF12 sequence with the A3,749U alteration" or "ARHGEF12 sequence with the A3,749U variation" referring to mRNA molecules, and "ARHGEF12 sequence with the A3,749T alteration" or "ARHGEF12 sequence with the A3,749T variation" referring to cDNA molecules). The same can be carried out for all other molecules disclosed herein.

As described herein, a position within an ARHGEF12 genomic nucleic acid molecule that corresponds to position 132,939 according to SEQ ID NO:2, for example, can be identified by performing a sequence alignment between the nucleotide sequence of a particular ARHGEF12 nucleic acid molecule and the nucleotide sequence of SEQ ID NO:2. A variety of computational algorithms exist that can be used for performing a sequence alignment to identify a nucleotide position that corresponds to, for example, position 132,939 in SEQ ID NO:2. For example, by using the NCBI BLAST algorithm (Altschul et al., Nucleic Acids Res., 1997, 25, 3389-3402) or CLUSTALW software (Sievers and Higgins, Methods Mol. Biol., 2014, 1079, 105-116) sequence alignments may be performed. However, sequences can also be aligned manually.

The amino acid sequences of ARHGEF12 reference polypeptides are set forth in SEQ ID NO:70 (Isoform 1), SEQ ID NO:71 (Isoform 2), SEQ ID NO:72 (Isoform 3), and SEQ ID NO:73 (Isoform 4).

Referring to SEQ ID NO:70 (Isoform 1), the ARHGEF12 reference polypeptide is 1,544 amino acids in length. Referring to SEQ ID NO:70, position 973 is tyrosine. Referring to SEQ ID NO:70, position 1,306 is tyrosine. Referring to SEQ ID NO:70, position 1,156 is glutamic acid.

Referring to SEQ ID NO:71 (Isoform 2), the ARHGEF12 reference polypeptide is 1,525 amino acids in length. Referring to SEQ ID NO:71, position 954 is tyrosine. Referring to SEQ ID NO:71, position 1,287 is tyrosine. Referring to SEQ ID NO:71, position 1,137 is glutamic acid.

Referring to SEQ ID NO:72 (Isoform 3), the ARHGEF12 reference polypeptide is 1,441 amino acids in length. Referring to SEQ ID NO:72, position 870 is tyrosine. Referring to SEQ ID NO:72, position 1,203 is tyrosine. Referring to SEQ ID NO:72, position 1,053 is glutamic acid.

Referring to SEQ ID NO:73 (Isoform 4), the ARHGEF12 reference polypeptide is 1,078 amino acids in length. Referring to SEQ ID NO:73, position 870 is tyrosine.

A set of ARHGEF12 variant polypeptides exists, wherein the tyrosines at the positions referred to above for the ARHGEF12 reference polypeptides (referring to SEQ ID NO:70, SEQ ID NO:71, SEQ ID NO:72, and SEQ ID NO:73) are replaced by phenylalanines. Referring to SEQ ID NO:74 (Tyr973Phe; Isoform 1), position 973 is phenylalanine. Referring to SEQ ID NO:75 (Tyr954Phe; Isoform 2), position 954 is phenylalanine. Referring to SEQ ID NO:76 (Tyr870Phe-LONG; Isoform 3), position 870 is phenylalanine. Referring to SEQ ID NO:77 Tyr870Phe-SHORT; Isoform 4), position 870 is phenylalanine.

Another set of ARHGEF12 variant polypeptides exists, wherein the tyrosines at the positions referred to above for the ARHGEF12 reference polypeptides (referring to SEQ ID NO:70, SEQ ID NO:71, SEQ ID NO:72, and SEQ ID NO:73) are replaced by cysteines. Referring to SEQ ID NO:78 (Tyr1306Cys; Isoform 1), position 1,306 is cysteine. Referring to SEQ ID NO:79 (Tyr1287Cys; Isoform 2), position 1,287 is cysteine. Referring to SEQ ID NO:80 (Tyr1203Cys; Isoform 3), position 1,203 is cysteine.

Another set of ARHGEF12 variant polypeptides exists, wherein the codons encoding glutamic acids at the positions referred to above for the ARHGEF12 reference nucleic acid molecules encoding reference polypeptides (referring to SEQ ID NO:70, SEQ ID NO:71, SEQ ID NO:72, and SEQ ID NO:73) are replaced by stop codons. Referring to SEQ ID NO:81 (Glu1156STOP; Isoform 1), the ARHGEF12 variant polypeptide is 1,155 amino acids in length. Referring to SEQ ID NO:81, the ARHGEF12 variant polypeptide is truncated at position 1,155 and does not contain amino acids at positions corresponding to positions 1,156 to 1,544 of SEQ ID NO:70. Referring to SEQ ID NO:82 (Glu1137STOP; Isoform 2), the ARHGEF12 variant polypeptide is 1,136 amino acids in length. Referring to SEQ ID NO:82, the ARHGEF12 variant polypeptide is truncated at position 1,136 and does not contain amino acids at positions corresponding to positions 1,137 to 1,525 of SEQ ID NO:71. Referring to SEQ ID NO:83 (Glu1053STOP; Isoform 3), the ARHGEF12 variant polypeptide is 1,052 amino acids in length. Referring to SEQ ID NO:83, the ARHGEF12 variant polypeptide is truncated at position 1,052 and does not contain amino acids at positions corresponding to positions 1,053 to 1,441 of SEQ ID NO:72.

The present disclosure also provides isolated human ARHGEF12 polypeptides having an amino acid sequence at least about 90%, at least about 91%, at least about 92%, at least about 93%, at least about 94%, at least about 95%, at least about 96%, at least about 97%, at least about 98%, or at least about 99% identical to: SEQ ID NO:81, and terminating at a position corresponding to position 1,155 according to SEQ ID NO:81; SEQ ID NO:82, and terminating at a position corresponding to position 1,136 according to SEQ ID NO:82; or SEQ ID NO:83, and terminating at a position corresponding to position 1,052 according to SEQ ID NO:83. In some embodiments, the isolated human ARHGEF12 polypeptides have an amino acid sequence at least about 90% identical to: SEQ ID NO:81, and terminating at a position corresponding to position 1,155 according to SEQ ID NO:81; SEQ ID NO:82, and terminating at a position corresponding to position 1,136 according to SEQ ID NO:82; or SEQ ID NO:83, and terminating at a position corresponding to position 1,052 according to SEQ ID NO:83. In some embodiments, the isolated human ARHGEF12 polypeptides have an amino acid sequence at least about 92% identical to: SEQ ID NO:81, and terminating at a position corresponding to position 1,155 according to SEQ ID NO:81; SEQ ID NO:82, and terminating at a position corresponding to position 1,136 according to SEQ ID NO:82; or SEQ ID NO:83, and terminating at a position corresponding to position 1,052 according to SEQ ID NO:83. In some embodiments, the isolated human ARHGEF12 polypeptides have an amino acid sequence at least about 94% identical to: SEQ ID NO:81, and terminating at a position corresponding to position 1,155 according to SEQ ID NO:81; SEQ ID NO:82, and terminating at a position corresponding to position 1,136 according to SEQ ID NO:82; or SEQ ID NO:83, and terminating at a position corresponding to position 1,052 according to SEQ ID NO:83. In some embodiments, the isolated human ARHGEF12 polypeptides have an amino acid sequence at least about 96% identical to: SEQ ID NO:81, and terminating at a position corresponding to position 1,155 according to SEQ ID NO:81; SEQ ID NO:82, and terminating at a position corresponding to position 1,136 according to SEQ ID NO:82; or SEQ ID NO:83, and terminating at a position corresponding to position 1,052 according to SEQ ID NO:83. In some embodiments, the isolated human ARHGEF12 polypeptides have an amino acid sequence at least about 98% identical to: SEQ ID NO:81, and terminating at a position corresponding to position 1,155 according to SEQ ID NO:81; SEQ ID NO:82, and terminating at a position corresponding to position 1,136 according to SEQ ID NO:82; or SEQ ID NO:83, and terminating at a position corresponding to position 1,052 according to SEQ ID NO:83.

In some embodiments, the amino acid sequence of the isolated human ARHGEF12 polypeptide comprises SEQ ID NO:81, SEQ ID NO:82, or SEQ ID NO:83. In some embodiments, the amino acid sequence of the isolated human ARHGEF12 polypeptide comprises SEQ ID NO:81. In some embodiments, the amino acid sequence of the isolated human ARHGEF12 polypeptide consists of SEQ ID NO:81, SEQ ID NO:82, or SEQ ID NO:83. In some embodiments, the amino acid sequence of the isolated human ARHGEF12 polypeptide consists of SEQ ID NO:81.

In some embodiments, the isolated polypeptides comprise or consist of at least about 15, at least about 20, at least about 25, at least about 30, at least about 35, at least about 40, at least about 45, at least about 50, at least about 60, at least about 70, at least about 80, at least about 90, at least about 100, at least about 150, at least about 200, at least about 250, at least about 300, at least about 350, at least about 400, at least about 450, at least about 500, at least about 550, or at least about 600 contiguous amino acids of any of the ARHGEF12 polypeptides disclosed herein. In some embodiments, the isolated polypeptides terminate at a position corresponding to: position 1,155 according to SEQ ID NO:81, position 1,136 according to SEQ ID NO:82, or position 1,052 according to SEQ ID NO:83. In some embodiments, the isolated polypeptides terminate at a position corresponding to position 1,155 according to SEQ ID NO:81.

In some embodiments, the isolated polypeptides comprise or consist of an amino acid sequence at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% identical to at least about 8, at least about 10, at least about 15, at least about 20, at least about 25, at least about 30, at least about 35, at least about 40, at least about 45, at least about 50, at least about 60, at least about 70, at least about 80, at least about 90, at least about 100, at least about 150, at least about 200, at least about 250, at least about 300, at least about 350, at least about 400, at least about 450, at least about 500, at least about 550, or at least about 600 contiguous amino acids of any of the ARHGEF12 polypeptides disclosed herein. In some embodiments, the isolated polypeptides comprise or consist of an amino acid sequence at least about 90%, at least about 91%, at least about 92%, at least about 93%, at least about 94%, at least about 95%, at least about 96%, at least about 97%, at least about 98%, at least about 99%, or 100% identical to at least about 8, at least about 10, at least about 15, at least about 20, at least about 25, at least about 30, at least about 35, at least about 40, at least about 45, at least about 50, at least about 60, at least about 70, at least about 80, at least about 90, at least about 100, at least about 150, at least about 200, at least about 250, at least about 300, at least about 350, at least about 400, at least about 450, at least about 500, at least about 550, or at least about 600 contiguous amino acids of any of the ARHGEF12 polypeptides disclosed herein. In some embodiments, the isolated polypeptides terminate at a position corresponding to: position 1,155 according to SEQ ID NO:81, position 1,136 according to SEQ ID NO:82, or position 1,052 according to SEQ ID NO:83. In some embodiments, the isolated polypeptides terminate at a position corresponding to position 1,155 according to SEQ ID NO:81.

The isolated polypeptides disclosed herein can comprise an amino acid sequence of a naturally occurring ARHGEF12 polypeptide, or can comprise a non-naturally occurring sequence. In some embodiments, the naturally occurring sequence can differ from the non-naturally occurring sequence due to conservative amino acid substitutions. For example, the sequence can be identical with the exception of conservative amino acid substitutions.

In some embodiments, the isolated polypeptides comprise non-natural or modified amino acids or peptide analogs. For example, there are numerous D-amino acids or amino acids which have a different functional substituent than the naturally occurring amino acids.

The present disclosure also provides nucleic acid molecules encoding any of the polypeptides disclosed herein. This includes all degenerate sequences related to a specific polypeptide sequence (i.e., all nucleic acids having a sequence that encodes one particular polypeptide sequence as well as all nucleic acids, including degenerate nucleic acids, encoding the disclosed variants and derivatives of the protein sequences). Thus, while each particular nucleic acid sequence may not be written out herein, each and every sequence is in fact disclosed and described herein through the disclosed polypeptide sequences.

The present disclosure also provides compositions comprising any one or more of the nucleic acid molecules and/or any one or more of the polypeptides disclosed herein. In some embodiments, the compositions comprise a carrier. Examples of carriers include, but are not limited to, poly (lactic acid) (PLA) microspheres, poly(D,L-lactic-cogly-colic-acid) (PLGA) microspheres, liposomes, micelles, inverse micelles, lipid cochleates, and lipid microtubules.

The present disclosure also provides methods of producing any of the ARHGEF12 polypeptides or fragments thereof disclosed herein. Such ARHGEF12 polypeptides or fragments thereof can be produced by any suitable method.

The present disclosure also provides cells comprising any one or more of the nucleic acid molecules and/or any one or more of the polypeptides disclosed herein. The cells can be in vitro, ex vivo, or in vivo. Nucleic acid molecules can be linked to a promoter and other regulatory sequences so they are expressed to produce an encoded protein.

In some embodiments, the cell is a totipotent cell or a pluripotent cell such as, for example, an embryonic stem (ES) cell such as a rodent ES cell, a mouse ES cell, or a rat ES cell. In some embodiments, the cell is a primary somatic cell, or a cell that is not a primary somatic cell. The cell can be from any source. For example, the cell can be a eukaryotic cell, an animal cell, a plant cell, or a fungal (such as, for example, yeast) cell. Such cells can be fish cells or bird cells, or such cells can be mammalian cells, such as human cells, non-human mammalian cells, rodent cells, mouse cells or rat cells. Mammals include, but are not limited to, humans, non-human primates, monkeys, apes, cats dogs, horses, bulls, deer, bison, sheep, rodents (such as, for example, mice, rats, hamsters, guinea pigs), livestock (such as, for example, bovine species such as cows, steer, etc.; ovine species such as sheep, goats, etc.; and porcine species such as pigs and boars). The term "non-human animal" excludes humans.

The nucleotide and amino acid sequences listed in the accompanying sequence listing are shown using standard letter abbreviations for nucleotide bases, and three-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. The amino acid sequence follows the standard convention of beginning at the amino terminus of the sequence and proceeding forward (i.e., from left to right in each line) to the carboxy terminus.

The present disclosure also provides therapeutic agents that treat or inhibit glaucoma and/or elevated IOP for use in the treatment of glaucoma and/or elevated IOP (or for use in the preparation of a medicament for treating glaucoma and/or elevated IOP) in a subject, wherein the subject has any of the genomic nucleic acid molecules, mRNA molecules, and/or cDNA molecules encoding a human ARHGEF12 polypeptide described herein. The therapeutic agents that treat or inhibit glaucoma and/or elevated IOP can be any of the therapeutic agents that treat or inhibit glaucoma described herein.

In some embodiments, the subject comprises: i) a genomic nucleic acid molecule having a nucleotide sequence encoding a human ARHGEF12 polypeptide, wherein the nucleotide sequence comprises a thymine at a position corresponding to position 132,939 according to SEQ ID NO:2, or the complement thereof; ii) an mRNA molecule having a nucleotide sequence encoding a human ARHGEF12 polypeptide, wherein the nucleotide sequence comprises a uracil at a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, or position 2,615 according to SEQ ID NO:23 or the complement thereof; iii) a cDNA molecule having a nucleotide sequence encoding a human ARHGEF12 polypeptide, wherein the nucleotide sequence comprises a thymine at a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54, or the complement thereof; or iv) an ARHGEF12 polypeptide that comprises a phenylalanine at a position corresponding to: position 973 according to SEQ ID NO:74, position 954 according to SEQ ID NO:75, position 870 according to SEQ ID NO:76, or position 870 according to SEQ ID NO:77.

In some embodiments, the subject comprises: a genomic nucleic acid molecule having a nucleotide sequence encoding a human ARHGEF12 polypeptide, wherein the nucleotide sequence comprises a thymine at a position corresponding to position 132,939 according to SEQ ID NO:2, or the complement thereof; an mRNA molecule having a nucleotide sequence encoding a human ARHGEF12 polypeptide, wherein the nucleotide sequence comprises a uracil at a position corresponding to position 3,749 according to SEQ ID NO:16, or the complement thereof; a cDNA molecule having a nucleotide sequence encoding a human ARHGEF12 polypeptide, wherein the nucleotide sequence comprises a thymine at a position corresponding to position 3,749 according to SEQ ID NO:47, or the complement thereof; or an ARHGEF12 polypeptide that comprises a phenylalanine at a position corresponding to position 973 according to SEQ ID NO:74.

In some embodiments, the subject comprises: i) a genomic nucleic acid molecule having a nucleotide sequence encoding a human ARHGEF12 polypeptide, wherein the nucleotide sequence comprises a guanine at a position corresponding to position 143,698 according to SEQ ID NO:3, or the complement thereof; ii) an mRNA molecule having a nucleotide sequence encoding a human ARHGEF12 polypeptide, wherein the nucleotide sequence comprises a guanine at a position corresponding to: position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, or position 3,614 according to SEQ ID NO:30, or the complement thereof; iii) a cDNA molecule having a nucleotide sequence encoding a human ARHGEF12 polypeptide, wherein the nucleotide sequence comprises a guanine at a position corresponding to: position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, or position 3,614 according to SEQ ID NO:61 or the complement thereof; or iv) an ARHGEF12 polypeptide that comprises a cysteine at a position corresponding to: position 1,306 according to SEQ ID NO:78, position 1,287 according to SEQ ID NO:79, or position 1,203 according to SEQ ID NO:80.

In some embodiments, the subject comprises: a genomic nucleic acid molecule having a nucleotide sequence encoding a human ARHGEF12 polypeptide, wherein the nucleotide sequence comprises a guanine at a position corresponding to position 143,698 according to SEQ ID NO:3, or the complement thereof; an mRNA molecule having a nucleotide sequence encoding a human ARHGEF12 polypeptide, wherein the nucleotide sequence comprises a guanine at a position corresponding to position 4,748 according to SEQ ID NO:24, or the complement thereof; a cDNA molecule having a nucleotide sequence encoding a human ARHGEF12 polypeptide, wherein the nucleotide sequence comprises a guanine at a position corresponding to position 4,748 according to SEQ ID NO:55, or the complement thereof; or an ARHGEF12 polypeptide that comprises a cysteine at a position corresponding to position 1,306 according to SEQ ID NO:78.

In some embodiments, the subject comprises: i) a genomic nucleic acid molecule having a nucleotide sequence encoding a human ARHGEF12 polypeptide, wherein the nucleotide sequence comprises a thymine at a position corresponding to position 141,048 according to SEQ ID NO:4, or the complement thereof; ii) an mRNA molecule having a nucleotide sequence encoding a human ARHGEF12 polypeptide, wherein the nucleotide sequence comprises a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; iii) a cDNA molecule having a nucleotide sequence encoding a human ARHGEF12 polypeptide, wherein the nucleotide sequence comprises a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof; or iv) an ARHGEF12 polypeptide that terminates at a position corresponding to: position 1,155 according to SEQ ID NO:81, position 1,136 according to SEQ ID NO:82, or position 1,052 according to SEQ ID NO:83.

In some embodiments, the subject comprises: a genomic nucleic acid molecule having a nucleotide sequence encoding a human ARHGEF12 polypeptide, wherein the nucleotide sequence comprises a thymine at a position corresponding to position 141,048 according to SEQ ID NO:4, or the complement thereof; an mRNA molecule having a nucleotide sequence encoding a human ARHGEF12 polypeptide, wherein the nucleotide sequence comprises a uracil at a position corresponding to position 4,297 according to SEQ ID NO:31, or the complement thereof; a cDNA molecule having a nucleotide sequence encoding a human ARHGEF12 polypeptide, wherein the nucleotide sequence comprises a thymine at a position corresponding to position 4,297 according to SEQ ID NO:62, or the complement thereof; or an ARHGEF12 polypeptide that terminates at a position corresponding to position 1,155 according to SEQ ID NO:81.

In some embodiments, the subject comprises a genomic nucleic acid molecule having a nucleotide sequence encoding a human ARHGEF12 polypeptide, wherein the nucleotide sequence comprises an adenine at a position corresponding to position 73,039 according to SEQ ID NO:5, or the complement thereof.

In some embodiments, the subject comprises a genomic nucleic acid molecule having a nucleotide sequence encoding a human ARHGEF12 polypeptide, wherein the nucleotide sequence comprises a cytosine at a position corresponding to position 121,307 according to SEQ ID NO:6, or the complement thereof.

In some embodiments, the subject comprises a genomic nucleic acid molecule having a nucleotide sequence encoding a human ARHGEF12 polypeptide, wherein the nucleotide sequence comprises a cytosine at a position corresponding to position 141,978 according to SEQ ID NO:7, or the complement thereof.

The present disclosure also provides ARHGEF12 inhibitors for use in the treatment of glaucoma and/or elevated IOP (or for use in the preparation of a medicament for treating glaucoma and/or elevated IOP) in a subject, wherein the subject has any of the genomic nucleic acid molecules, mRNA molecules, and/or cDNA molecules encoding a human ARHGEF12 polypeptide described herein. The ARHGEF12 inhibitors can be any of the ARHGEF12 inhibitors described herein.

In some embodiments, the subject comprises: i) a genomic nucleic acid molecule having a nucleotide sequence encoding a human ARHGEF12 polypeptide, wherein the nucleotide sequence comprises a thymine at a position corresponding to position 132,939 according to SEQ ID NO:2, or the complement thereof; ii) an mRNA molecule having a nucleotide sequence encoding a human ARHGEF12 polypeptide, wherein the nucleotide sequence comprises a uracil at a position corresponding to: position 3,749 according to SEQ ID NO:16 or the complement thereof, position 3,191 according to SEQ ID NO:17 or the complement thereof, position 3,079 according to SEQ ID NO:18 or the complement thereof, position 3,692 according to SEQ ID NO:19 or the complement thereof, position 3,046 according to SEQ ID NO:20 or the complement thereof, position 2,925 according to SEQ ID NO:21 or the complement thereof, position 3,054 according to SEQ ID NO:22 or the complement thereof, or position 2,615 according to SEQ ID NO:23 or the complement thereof; iii) a cDNA molecule having a nucleotide sequence encoding a human ARHGEF12 polypeptide, wherein the nucleotide sequence comprises a thymine at a position corresponding to: position 3,749 according to SEQ ID NO:47 or the complement thereof, position 3,191 according to SEQ ID NO:48 or the complement thereof, position 3,079 according to SEQ ID NO:49 or the complement thereof, position 3,692 according to SEQ ID NO:50 or the complement thereof, position 3,046 according to SEQ ID NO:51 or the complement thereof, position 2,925 according to SEQ ID NO:52 or the complement thereof, position 3,054 according to SEQ ID NO:53 or the complement thereof, or position 2,615 according to SEQ ID NO:54, or the complement thereof; or iv) an ARHGEF12 polypeptide that comprises a phenylalanine at a position corresponding to: position 973 according to SEQ ID NO:74, position 954 according to SEQ ID NO:75, position 870 according to SEQ ID NO:76, or position 870 according to SEQ ID NO:77.

In some embodiments, the subject comprises: a genomic nucleic acid molecule having a nucleotide sequence encoding a human ARHGEF12 polypeptide, wherein the nucleotide sequence comprises a thymine at a position corresponding to position 132,939 according to SEQ ID NO:2, or the complement thereof; an mRNA molecule having a nucleotide sequence encoding a human ARHGEF12 polypeptide, wherein the nucleotide sequence comprises a uracil at a position corresponding to position 3,749 according to SEQ ID NO:16, or the complement thereof; a cDNA molecule having a nucleotide sequence encoding a human ARHGEF12 polypeptide, wherein the nucleotide sequence comprises a thymine at a position corresponding to position 3,749 according to SEQ ID NO:47, or the complement thereof; or an ARHGEF12 polypeptide that comprises a phenylalanine at a position corresponding to position 973 according to SEQ ID NO:74.

In some embodiments, the subject comprises: i) a genomic nucleic acid molecule having a nucleotide sequence encoding a human ARHGEF12 polypeptide, wherein the nucleotide sequence comprises a guanine at a position corresponding to position 143,698 according to SEQ ID NO:3, or the complement thereof; ii) an mRNA molecule having a nucleotide sequence encoding a human ARHGEF12 polypeptide, wherein the nucleotide sequence comprises a guanine at a position corresponding to: position 4,748 according to SEQ ID NO:24 or the complement thereof, position 4,190 according to SEQ ID NO:25 or the complement thereof, position 4,078 according to SEQ ID NO:26 or the complement thereof, position 4,691 according to SEQ ID NO:27 or the complement thereof, position 4,045 according to SEQ ID NO:28 or the complement thereof, position 3,924 according to SEQ ID NO:29 or the complement thereof, or position 3,614 according to SEQ ID NO:30, or the complement thereof; iii) a cDNA molecule having a nucleotide sequence encoding a human ARHGEF12 polypeptide, wherein the nucleotide sequence comprises a guanine at a position corresponding to: position 4,748 according to SEQ ID NO:55 or the complement thereof, position 4,190 according to SEQ ID NO:56 or the complement thereof, position 4,078 according to SEQ ID NO:57 or the complement thereof, position 4,691 according to SEQ ID NO:58 or the complement thereof, position 4,045 according to SEQ ID NO:59 or the complement thereof, position 3,924 according to SEQ ID NO:60 or the complement thereof, or position 3,614 according to SEQ ID NO:61 or the complement thereof; or iv) an ARHGEF12 polypeptide that comprises a cysteine at a position corresponding to: position 1,306 according to SEQ ID NO:78, position 1,287 according to SEQ ID NO:79, or position 1,203 according to SEQ ID NO:80.

In some embodiments, the subject comprises: a genomic nucleic acid molecule having a nucleotide sequence encoding a human ARHGEF12 polypeptide, wherein the nucleotide sequence comprises a guanine at a position corresponding to position 143,698 according to SEQ ID NO:3, or the complement thereof; an mRNA molecule having a nucleotide sequence encoding a human ARHGEF12 polypeptide, wherein the nucleotide sequence comprises a guanine at a position corresponding to position 4,748 according to SEQ ID NO:24, or the complement thereof; a cDNA molecule having a nucleotide sequence encoding a human ARHGEF12 polypeptide, wherein the nucleotide sequence comprises a guanine at a position corresponding to position 4,748 according to SEQ ID NO:55, or the complement thereof; or an ARHGEF12 polypeptide that comprises a cysteine at a position corresponding to position 1,306 according to SEQ ID NO:78.

In some embodiments, the subject comprises: i) a genomic nucleic acid molecule having a nucleotide sequence encoding a human ARHGEF12 polypeptide, wherein the nucleotide sequence comprises a thymine at a position corresponding to position 141,048 according to SEQ ID NO:4, or the complement thereof; ii) an mRNA molecule having a nucleotide sequence encoding a human ARHGEF12 polypeptide, wherein the nucleotide sequence comprises a uracil at a position corresponding to: position 4,297 according to SEQ ID NO:31 or the complement thereof, position 3,739 according to SEQ ID NO:32 or the complement thereof, position 3,627 according to SEQ ID NO:33 or the complement thereof, position 4,240 according to SEQ ID NO:34 or the complement thereof, position 3,594 according to SEQ ID NO:35 or the complement thereof, position 3,473 according to SEQ ID NO:36 or the complement thereof, position 3,602 according to SEQ ID NO:37 or the complement thereof, or position 3,163 according to SEQ ID NO:38 or the complement thereof; iii) a cDNA molecule having a nucleotide sequence encoding a human ARHGEF12 polypeptide, wherein the nucleotide sequence comprises a thymine at a position corresponding to: position 4,297 according to SEQ ID NO:62 or the complement thereof, position 3,379 according to SEQ ID NO:63 or the complement thereof, position 3,627 according to SEQ ID NO:64 or the complement thereof, position 4,240 according to SEQ ID NO:65 or the complement thereof, position 3,594 according to SEQ ID NO:66 or the complement thereof, position 3,473 according to SEQ ID NO:67 or the complement thereof, position 3,602 according to SEQ ID NO:68 or the complement thereof, or position 3,163 according to SEQ ID NO:69 or the complement thereof; or iv) an ARHGEF12 polypeptide that terminates at a position corresponding to: position 1,155 according to SEQ ID NO:81, position 1,136 according to SEQ ID NO:82, or position 1,052 according to SEQ ID NO:83.

In some embodiments, the subject comprises: a genomic nucleic acid molecule having a nucleotide sequence encoding a human ARHGEF12 polypeptide, wherein the nucleotide sequence comprises a thymine at a position corresponding to position 141,048 according to SEQ ID NO:4, or the complement thereof; an mRNA molecule having a nucleotide sequence encoding a human ARHGEF12 polypeptide, wherein the nucleotide sequence comprises a uracil at a position corresponding to position 4,297 according to SEQ ID NO:31, or the complement thereof; a cDNA molecule having a nucleotide sequence encoding a human ARHGEF12 polypeptide, wherein the nucleotide sequence comprises a thymine at a position corresponding to position 4,297 according to SEQ ID NO:62, or the complement thereof; or an ARHGEF12 polypeptide that terminates at a position corresponding to position 1,155 according to SEQ ID NO:81.

In some embodiments, the subject comprises a genomic nucleic acid molecule having a nucleotide sequence encoding a human ARHGEF12 polypeptide, wherein the nucleotide sequence comprises an adenine at a position corresponding to position 73,039 according to SEQ ID NO:5, or the complement thereof.

In some embodiments, the subject comprises a genomic nucleic acid molecule having a nucleotide sequence encoding a human ARHGEF12 polypeptide, wherein the nucleotide sequence comprises a cytosine at a position corresponding to position 121,307 according to SEQ ID NO:6, or the complement thereof.

In some embodiments, the subject comprises a genomic nucleic acid molecule having a nucleotide sequence encoding a human ARHGEF12 polypeptide, wherein the nucleotide sequence comprises a cytosine at a position corresponding to position 141,978 according to SEQ ID NO:7, or the complement thereof.

All patent documents, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the present disclosure can be used in combination with any other feature, step, element, embodiment, or aspect unless specifically indicated otherwise. Although the present disclosure has been described in some detail by way of illustration and example for purposes of clarity and understanding, it will be apparent that certain changes and modifications may be practiced within the scope of the appended claims.

The following examples are provided to describe the embodiments in greater detail. They are intended to illustrate, not to limit, the claimed embodiments. The following examples provide those of ordinary skill in the art with a disclosure and description of how the compounds, compositions, articles, devices and/or methods described herein are made and evaluated, and are intended to be purely exemplary and are not intended to limit the scope of any claims. Efforts have been made to ensure accuracy with respect to numbers (such as, for example, amounts, temperature, etc.), but some errors and deviations may be accounted for. Unless indicated otherwise, parts are parts by weight, temperature is in ° C. or is at ambient temperature, and pressure is at or near atmospheric.

EXAMPLES

Example 1: ARHGEF12 Variants

Figure 1B:
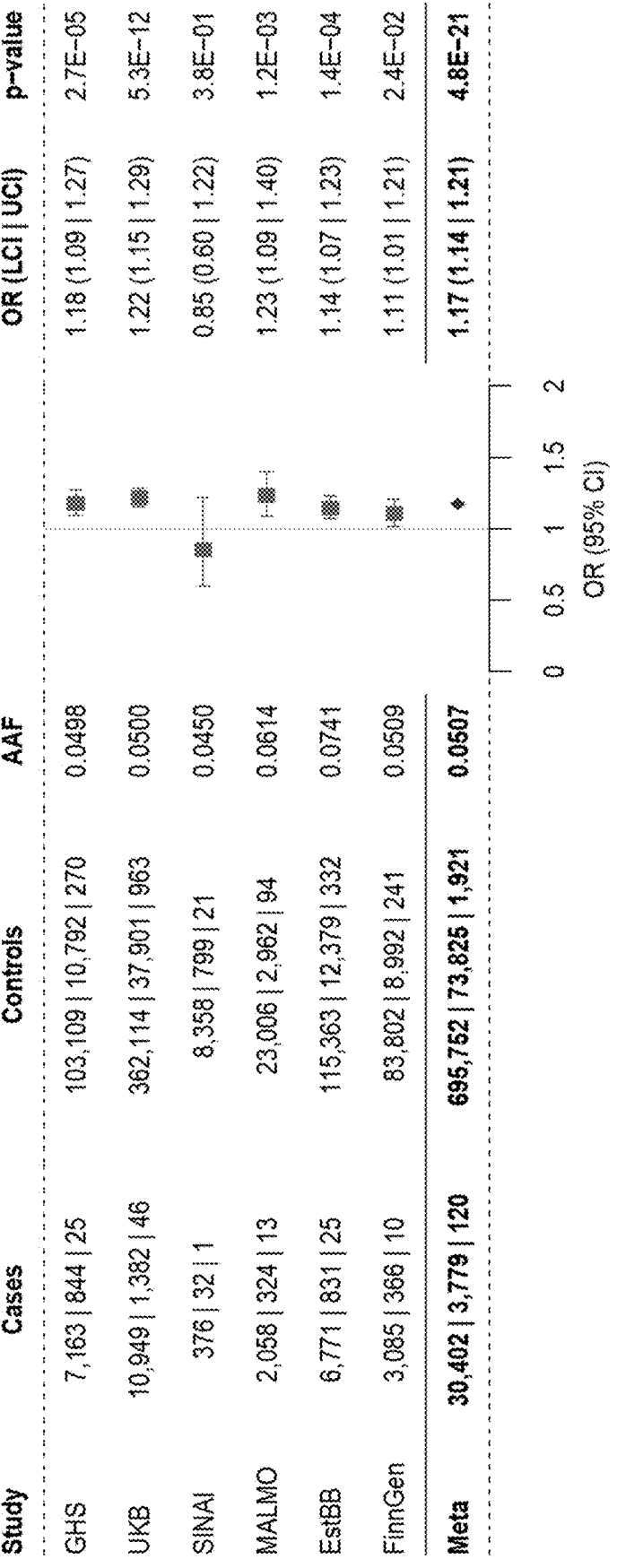
FIG. 1B depicts a missense variant in ARHGEF12 (Tyr973Phe) associated with increased risk for glaucoma.
Figure 2:
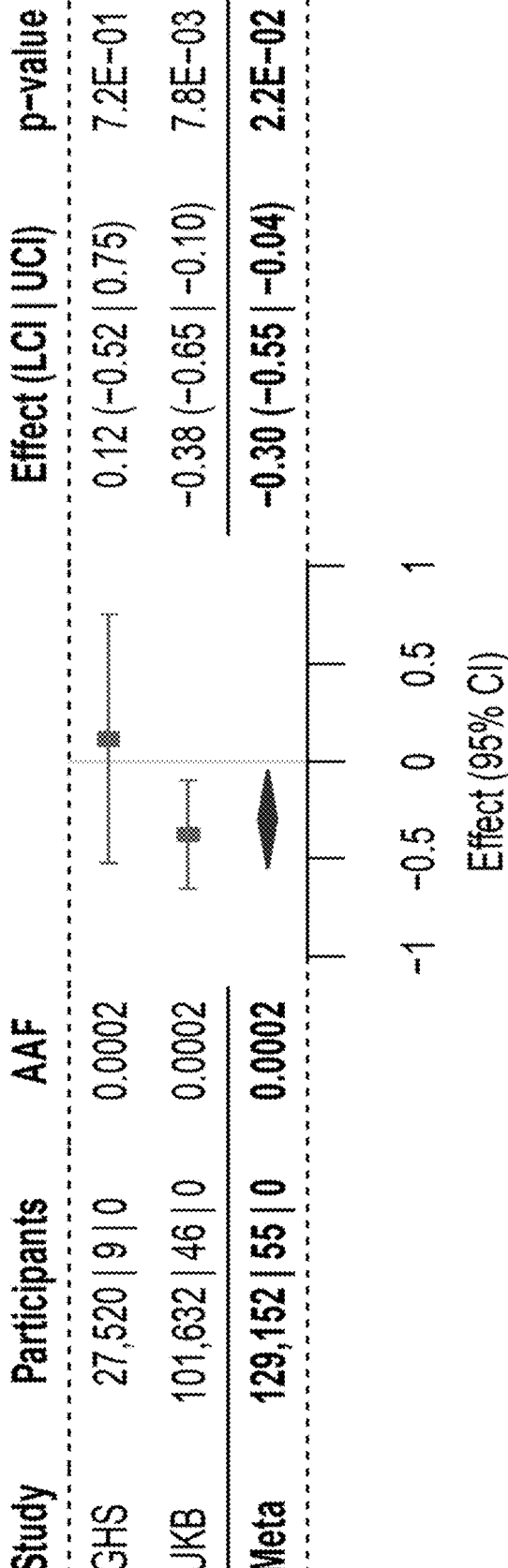
FIG. 2 depicts an aggregate of predicted loss-of-function variants in ARHGEF12 associated with a decrease in IOP.

Genome-wide and exome-wide meta-analysis was performed across several datasets including the UK Biobank and Geisinger and associations of variants in ARHGEF12 with intraocular pressure and glaucoma risk were identified. A common missense variant (Tyr973Phe), that is associated with increased intraocular pressure and increased risk for glaucoma (FIG. 1A and FIG. 1B, respectively) was identified. Association of a burden of predicted loss-of-function variants (pLOF) in ARHGEF12 with reduced intraocular pressure was also identified (FIG. 2). The association with ARHGEF12 pLOF variants with reduced IOP suggests that loss of ARHGEF12 function may be protective for glaucoma.

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety and for all purposes.

SEQUENCE LISTING (110 sequences)

SEQ ID NO: 1 - DNA, 153525 bp, Homo sapiens
  source 1..153525: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggttggtatgaattcctccttcgttcggcctcccggaatcgggcccgacctagcaggggagtcggtgattgcagattgcctttggccagcgaagttgacaggcagaggaaagagggttgtttcggagctgtgcagttagcctggggttgctgccgagttatccagttgattggcttttggaaatgtaatttttccggagagaaacttcccttccgattctcagagaagggggaggcaaaaccatgattgtggttttccgcctgtagtgtgcattaggattgtgtactcgtctggaaatcagaggagaaggtcattttaggtgaaggtcggtgcctgaagtcggctcggtattggtgtattatttatcagctttagccgtgtcctgcagtagattctcaagacaattacattttaggaatttctacctgtgaacttaatgttgagcctactgcatggtgatctgggaacttgatctctttcagatgttgacctgcacggtgtttaattattatctaataactttccagaatgttgacattaccagtaaatcacaggttcttgctggaagcaatgtccaggagctgaagaaatgagggtaaatcatggggtttgcttttaattcttgtatttaaatatttcgtcttccagaaacacttggcgtttaagagatataagccgtaagcatagtgtaagcgcgcagctgaatttgttgagttctgtgtctgtcctttatagcacctaccagtgttgcatggtggtgggtggcgaattgagctagaccatgtgtggttgaagtgcagtttgcttatcctaagttactcttgtttatagggtaagggataaaaagcatattgattccttgaccacatttcattctcaatttaattatgacactgcatgctagtcccaaatttgtcagcttgctttatttttaagtcagtcttcgaattattacaccgtgaaaaaatagatcaagtaactgaattagagggccaaagctctttgatgaaaagtgcaacaatagtgcttctgcacaaagtagtcttaatttcctaataagagttttacccaattgtaagactcatttgttgattttaaaagggccaaattccattatcataccataacagctactccagaaacagaacttcctcttcctgttgatgctttccagcatcacatgaatgttcacttaaaagagtctgttaaatatttaaagtatttatatttactctttgtgtatttttcaaagtgggttttcattttcaatgaaataatttttaacttttccaagaatacacttaagataagtattgacaatgcttatcttactttcttctggttatccccatttttttcctttcagggtgttttgcttctgagaaatcacttttacgggtgtggggataattgttttcctgcttcattcaattctcgctctttctgttgagcctgtaaacaaaagtcttgctaggaactaatgtaatgttggttttcattgcgatgctgaggtgtttaatttatggaaacagaacggactcattccacacacaagtgagtgaaaagccctcaagtaatggtttttcttcagcattgcttctcagggattttccttgtcttctcgttatcttggaaatagaatcttggaatttgtatcctctttataacgtagatggcatataaacattcaataaatatgaaattactgaaagcctgtttcttttctttttcttttttttttttttttttggccaggcactgtgcaggcacaagagattacaaaatgaatattgtaagattaatctgcaaattggtttgggcattaatgttttttgaactggttcaggtgctgctgcctaattttacattttttttttttaaagaaaagaccttggaaagccaattaataagcactgctgagacctgtttcgtaggatttttttttactagggtctttttttattaagaattattcttatttgaccacatttaaatatattttgtaaatataaagcatccatttgctgttaagagagtagttgttcctaatatgaatatatgttggggtgaaatctggaggtactggtttagtattatttctctgccaaggtgtcttaacaaagttacgagtatataatagtttctagctttctgtcagccctacctcatccttttttcgtagtgtctaactcttactgtaggtatattttgctgactctagaactgttggaaaattaacagcaccagtgtagctttttagatagagatcctttcaagtttgaagtgctgtatgtggtatggctttgtttcgtagagtgtgcagaaccaccaggccagctgtgtgagttagagttctttcattgtggtgcttctgactacagagtctgtctgtcctcagttgaaatcagactagctggttttgggcgttgttctgttttgcagtttgtggcaggcgacacatggctgaacaagataagggttttattcttgtgttagggacgtgctggggctgggatggaattcagctatgtttaggctctgattggtcactttggatactcagaactctgttacatcctgttattattttgcagttaaatcaacacattaacttgctctcttctctttcccttcatcttttactccccagtccgcaccccttaaaacctaaaactcaaactttttaaaagactttaaactcaaactatgttcatggtagctattacttctatgtagtatatccaaacagctttaaaaaaaatggtaagcaatttatgagccctggagtctgtagttttcatcgtttagaatgagcacttgacaagtgtagaaatgtctgattgctgctttttagtctgcattgattgctgcattcagtcttaaaatacatcctaatcgtttccaatcctcctacatgtctttcttgtatccctgagaatttaggggtcctatagcaattggaatttcttctgagaggtagacaggagagaatgcccttttagtagactcagtaaatgatttcaggccagtgtctataacattgaattttcagggacagtacaggtaggaaagttatagggttcttccttgaaataaatggacttttgttttggctagggcttatgaattttgtagtttttgatttatagataaagacaggtttttgatacaatttttttaaagcactgaattcagctttgagctgtttaacttaagcagatttttaaagtgagtgtggaaacctgtgactttatatgcctgtacccagtaattaatgatacttttcattagtgatactttttctgtcaaaattgctgtataatggttttgattaaaaaaaaaagagctactcatgtttatatgttattttcaacgttgcatgagtcatctctcggcaaggtgaaattatttgtaaccttttcttgtaaagtcagccagtccataaatacaaaattgaaatgggggccaaagatcacagtgttagttttgtattcagttttatctttgcctttttagttcagtataaaatcttgagtcataaaggtatgcaatagtacattcacttgtacagttttacatgagtcaacatgcagaatctaaagtaactttttttgaaagtacagtgttgtagtcttcctgattaatggtacatttatatgatgttcatattcagtaaggtgacaagagaagctttatttgaaatcattacaaaaatatgttaaccttggaataccacttaacacattggtggtttccggttgttaacatgtatataccatcgagttaacatgtaggtttttttcttttttgagtcttgctctgtcacccacggtggagtgcagtggcgtgatcccctcactgcaacctccgcctcccaggttcaagcggttctcctgcctcagcctcctgagtagctgggattacaggcacccaccaccacgcctggctaatttttgtatttttagtagagacggggtttcaccatattggccaggctggtcttgaactcctgaccttaggtgatccacccgtctcggcctcccaaagtgccgggattacaggcttgagccaccgagcccagtggttttttttgttgttgctgttgttgttttttaactaagtttgagttttcagtttaaaaaatgaaatttgaggcaaacattcatggaatccataaatggtgaattttacatatgtttctgtggagcattgcgattccagggaaaacagttggaaaatatttcattgtacatatgtggttgcctcttctaaatgtcatccagtggtgggtatgaattgcttcccaaactgatacgggtcacagaaacagcaagataacatactggttcccagaggtaattgaagggactcttttgcatcatggttgtctgacattattagaaatgtttcttatatacttgcttgtttcctagaaattgaccatgacacattttcaagaatagtagcttaacttcttttggtcttttctgttaaaacttggttttgatgatgttcctgagctttatttgaagacatgctcctttcccttataataattacaggttttcaaaatagtgccatgtgagttaaaatttttaaatcaacaaaattatatttttgccttcttttgagtaaaataccatcatgtaggtaatgatatcctgtggtagtataattctttaacatttacaatattttcagttcagtacagggcagatcatgcttctgtcatttacactttaagctaattcatacagtttaagtcaagattttaagtcaagattataaaactagaaagggcagacccaagattttaacctagattttctggctctcaagtcccccattgttttttttcattttaaattattgtctttctttgtactgtatttttctgtgctattttcctttagtaactctccagcttgatgaagtcagttggatttttctcttacagcatagtttctagtaccttacccattctaattttaaatatctcttgaggataaagcttttgtcacttcctcaggagactgaagcacagtctgatagatcttgctgtcaggaagtttttcctgatctttacgtctaacttttcttttaagttgtcctgttacttgtatgtacttgctgtaccaggctaaataatgctctcctcccattttatgtttgtatgattctaaatgtttcagacggttattcattatcctttccggtccccttcccttactctttgcttagccaagctgtatgctttctgttgatccattgtctaaaaatcagcttatcttaatatttcattagctttttctcagttgctctcctactgcaaaaatatgggtaaagagattctcaaggtcattttgattcacttttattttagatagtctttaggatggatatgagatatgtcacagtcaaatgaaacaaatttatacaaacagcatgattaccaaatcaactaattaagcaattactcatgttctaaaaggcttttttacaaagcgattctttcaaatatgagtaccctcaatgtaacaaatgttatcaattctatgacaaaagggtagggtatagaaataatgttagccacctttgatggaaaatcatcttgttgcaatatgatgaaatacatcaggaagttgtttcttattttttccagtggtttttcagttcgttatcttaaattgtaggtcaaaacattcctcgatgtttggtttatttttaccttattgttttgtctcctcttatttccacatgttagtgaaataacaatgcttagcagtattttttttttcagtaaaatggatattgtgaaaattgaaatattttactttcttgctgttgtatttacaagaattgttaatgacaagacagtgtaacagaaaaagtgcatatttagattattataaaatctgtaagactgtagaccttttgaatactttattagcatattttctttagtactattttagtttcaaattattgagatagatgtccttgttttgtattttgctaatattaatattttgtattttggtaatactaaaatttgcaaacatgccaaatttagagcattttactttttcaacttagaatatctggaatcatcaagatagtcatatagggaagaccgctataagacagcttctaactccaatagaagcctatgaagctagtgcctggtcagaggctgtgcctaaattgcatgagtatatagtgtcgacttttagtaaaagaaaaaatacactaactttacctcttgaattagcatgcaccaatgcagtttagattcataccgaaacaggatcttttactaattcaaatgctgagtcctggtttttgagatcacagtcacatgacaggcctgggtggcttctcagtgtctagagacaagcaaatctactggccaatgaaaagtaggtttcctgtcttggactgcaagtaacaattcatgcagaaattggaactatataagagagcctggttttagttaatgctttcaattagctgcttgtcacactgctttttcttttggtgttatataacacattagagtcatttaaaggtacactctgatactacagtttttgtcaaatattacatataaatgttgattttacattcatatactcaaaagatcaaagaggactttgtagatcttttatggattcaaaaaaatgtagattattttgttgtagaaaaactggccaggcgcggtggctcatgcctgtaaatcccagcactttggaaggctgaggtgggcggatcacttgaggtcaagagttcaagactagcctggtcagcatggtgaaaccctgtctctattaaaaatacaaaaatgagccggaccaggtggcacatgcctgtaatcccagctactcgggaggctaagacaggagaatcacttgaacccgggaggcggaggttgcagttagccaagattgcaccactgcactcctacctggatgacagagcaagactccgtctcaaaaaaaaaaaaaaaaaaaaaaaaaaaaactggagacttcatcagcctctgaaggaatgatacctgaaattgatcttgtaatgcagaaagtggctatatgttatccagaagagtaacagataccccaaatacacttgctaacacaagaaatcctgtgaaggtgcttagacatacccttccatagattttagatgggttatctgcctatgttccagacacaagccgatatgttgtggtttgcccagtacagtctctgtggtttactgagaggaagtggttcttgtgggtgaaggtctgatcttttcagagattgttggtggcatatgcactgtcagcctatttcctgttttattggctgtttagcaagaccttcttagggcaagtgctgctgaagaggtatttaaatattttgtattggcaggatagatggttataatgatgtattattatatcactacttctcaggtgatatgagagttaaatgaatgtttgtgaagtgctttgagatcttaggatgaaaagtacagacatgttcttagtcatttgcaggttactgctatgttcagatattgctctcttgaagttaaaacttgttcatgtagtaaagtgttactctattaaacttgatttctgtaaccattcaagtgttgttttatcaccacaagagtcatgattagaatttttcccctttttttcctttctttcaatgctcctttatgattttaccctagaagagtttccttaatagattccttgctctagtactggttaaggcatatttaccaaacttaacacctagcaagcttgtccaacctgccttattttgctgttgttcttctgttttgttttgttttaggctttcagcagcctgaagccatggtttttagtttctgtctctagtgataaaacggaaagagggatgaggaaggggctttactggcccatccagaaacagaaactaagaacccatgactgtattctctcccttgaacaactgtaactagagcaaacctctttgccaatttaactggcatactaaaataatgaaattgtgagaatttcctttgagattagtaactgtaccatccatatacaaaacactatattgctttgctgaaacctgaaagtgagcaaactgatagaaatgcatataacaggccgggcgtagtggctcacgcctgtaatcccagcactttgggagaccgaggtgggcggttcaggaggtcaggagatcaagaccattctggctaacacggtgaaaccccgtctctgctaaaaatagaaaaaattagccgagtgtggtggcgggtgcctgtagtcccagctgctggggaggctgaggcaggagaatggcatgaacccaggaggtggagcttgcagtgagccgagatcgcgccactgcactccagcctgggcacagagcgagactccgtctcaaaaaaaaaaaaaaaaaaaacgaaatggcgtatgtcatactcctaaatatatatatatatacagtatttagccttggacgttaaaaaaattaacaatgaatgggggaaggctttatttaaagctaaattgttagctaatacgtgagttcttcaagggtataagaatagttcttattcatttttaagtaattatcggtagccttattatatttttattttttaatactgaaaagcagaaggaagaaaaataaatggcccaaatgatccaactacccagatgttgctgctcaggttaaacgcacacacgcatacacacacagaaaattcaaatcatataaaatggtataaaaaaaagtattcctacacacctgttagttttcataccttctcctcataggtaacaatagttaatttttttggtttatcttctgaaacatttaaaaatatataccagcctataattttattttttgcacctactccataataagtgtatctgtcttcttttgctaggttatgctgctgtagcaacactatcaaatttcagtggcttacaacactgcttttcttcttgcttatgctacaccttgtcagctgtggattgactgcagcattgcttcacgtttcttattttggaaccctggctcaaggagcatcccctgtctgggctgtgccattattgtggatgagggagagagcaagaaaacagatgcagacatacaatggctcttaaagctttcactcagtcatgttgtatgtcacatcagctcacatgtcagtggccaaagcaagtcatatggtcagagctcactgtcagtggggtaaggatgtatagtccttccacaggtggcattgcaagttgcatgataacagataaggctgtataatcctcttaaggaaagtggaggttaaataatttggaacaataaataatatagtctacatcaacaagttcagtaaatgcttgttaaatgggttatttggagtctatgaaagtttctttttttttagtgggaaattcaaacataaacagaagtacagagaatggtatgatgaacctcccttgttccctttattactccagcagttaatgtacggacaatcttggtttatctgttttctttccccccttctcactagattattttgaagcagtttttggatatcataatttcacttacaagtatttcactaagtatttttaagagataaagtctgaacgtgtgacttctcatagtaaattattactgtctgatagggtgaggtaatagtactatatagactgacaggtgtcaagcagcagagcacgttcatagagcgtatctagaatttgacagcctgaacttgttttgatttcattttgagtatttctggaggaggcttacaacagaatgccatctacttttccagcctctccctttctttctttctttccttccttccttccttccttccttccttccttccttccttccttccttcctttctttctttctttctttctctttctttttctttctttctttctctctgtctctctctgtttctctctctctctctctctctgtctgtgtgtgtgtgtgtgtgtgtgtgtgtgtgtgtgtgtagcagaagcaggtaattaacctctggaaaaaataacattgcaacagatttgatttgcagaggtttcatttctcactgagcctctgttggaatgatgccagttgaaaggaatcccagctcttaatggctccaagtcttctgggagctctcagtgatgttattttctttggagaagaacatcagaatcatttataaaaatcctgtgttcacccatgccatttgctctgtggagaaaggatctatcatatctttaagatgatctctaagatgatataaaagtaaagaaattcatctatctaattttagtttagaaatcattaatgccaatttcagctgctcaggttagtttgtcttgaaggcctgaaagcctccattttgattcaagatgtcgtagattttatgagcattcagtataaccagtaagtttgtcatttccatggttgtagggaatatgagacattctgttatggatctaggattaccgtttcacaggacattctttttttggggggattgttaggtaataaacagtgggacacaaaataaacagatataatctcttcagtttgtagattttcaggtgacaatgaggtggcagaagaggatttgtgcagattaggaaataaataattattgtatataacatgatggaaatattttagtatagtaccactatcaaattaattttgtttccttaactagcttctttcattgtgtacagagacacttatattaaagtagtctttatagatatccagttagctttagttttttctaattacattatattgctagtctcatttcagagtccatgtaggaactacagtagaaaagtagctatcattggcttgtaaataaaattacttaattttgagtttttcttgggaaggaaaaaccagttttacagaattagtggagttgattctggttttggttacttgtgacaatatagtctatttaaaatataaataaataaaaatttgcccaagaagaataagtttgacttgccatgattcatactgtttttctgttgttgtatcacaattgagaacattagtttcagaggtaatagtttgtcagtatgggtcgagtagctctaatccaaaaatccaaaatcagaaatgcttcaaaatctgaaactttttgggtgccatgtgccacaggtggaaaattctacacgtaagtacataatacaaactttgtttcatgcacaaaattatttacagtagtgtataaaattaccgttaggcgggggccaggcatggtggctcaagcctgtaatcccagcactttgggaagtcgaggcaggcggatcacctgaggttgggagtttgagaccagcctgaacaacatggagaaaccccatctctactaaaaatacaaaattagctgggcatggtggcacatgcctgtaattccagctactcgggaggctgaggcaggagaatcgcttgaaccagggaggtggaggttcaagcgagccaagatcatgccactgcactccagcctggaaaacaagagcaaaacaccgtctcaaaaaaaataataataaaaaattaccttcaggctgtgcatatagagtgtacgtgaaacattaatgaattctgtgtttagacttgggtcccattcccaagatatcttactatgtatatgtaaatgttccaaaacacaaaaaaattcaaaatgaaacacttctggccccaagcattttgggtaagggatacccaatgtgtacctttgttaggataatatacttgtaccttggttgtattttagttgcaattgttagttgcacaatttgggggaatgtttgaggtctctatagtagttactgtatttaccaggaagccctgcatgattagaattcttgagacagtgtataaagttaaattgggtgtgttgcctggatgtgaacagtaaaaaaggagaagcttctcaccatacaattatagcttaaaaggaaccaggtacaattctgtttccaaaaatagaaagtaagtcaaatattatatggatatgtaatagtaattatattaattttgactccctggccgactttttttttgaagctatcattttttgtcagagataaaaagtagcttttaaaggaaaagatatctcagcccttaattatgtgtgtgtgtatgtgtgtgtatgtatttatttatatattttagcccttgtaagagaggagcagtggaagggaactgaaggagcatgatatagagaaaagagcctgggttttggtgtgttgcatttgttctgttactagctgggagaccttgggcaaatttacctctctgatcagcagtttaattttttcatctgtaaaaatgggaagaatacctactttgcagaattgtcgtgacgattaaatgagagtgtgtgtgagtacctagcacatcgtaagagagagctcagtaagttatagtagctgttattgtttaaacttcaggaattagctaggttttgctagaactttcatctgtgcttgtaagatctttttgaatccatatgtatttttagcagctgtggctaagatagtttttttcccttgctgtgataatattccttatcttttatatttcaggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagttctgtatttattaacatcagtttgtttatttattcagtaaatattgaatgcctgttctgtgtaggtcattgtcttggcagttattttgagctcttgctacctgctgaattatatcttaaaatgaagaaatttacatgatagagtgatatttattcatctgtgctgaagattaaagtgagaagtatgtggcaggcgcggtggctcacgcttgtaatcccagcactttgggaggccgaggtgggcggatcatgaggtcaggagatcgagaccatcctggctaacacggtgaaaccccatttctactaaaaatacgaaaaattagccgagtatggtggtgggcacctgtagtcccagctgctggggaggctgaggcaggagaatggcttgaacctgggaggcagtgcttgcagtgagctgagatcacgccactgcactccagcctgggtgacagagcaagactccgtctcaaaaaaaaaaaaaaagtgagaagtatgtgtatttgggggaagttgtagaatgaaataataatgattaaattgatcttatttccaaattttaaaaatgtggttactttctatcacatactgtctttttatgttttcctttttattttatttttcagtttagttatatttcagtgaactatttagaccaaaatggaaaagacattggtgtaagttggaatctaagaagttttagatgttcattgcttttgaacagaggaagtaacattttatggattgggcattgttttagtcactacttgaaggagaacctcttactcattatcagtctcttggaaatagcaactgattaagcctatatatactttgtgcatccagtgaaaatgtgataaatatgatgatcttttggtcagagaaggattctggaaactgcagtagtttgattagtaagacagtgtttaaatcatgattacttgttgctctaatattttagactttgaaagatgacaagatgtgatgtaggtgacaaagagcatttttaaaaatgggtgaaattggccgggtgcggtgactcacgcctataatcccagcactttgggaggctgaggcgggcggatcacaaggtcaggaaatcgagaccattctggctaacacggtgaaaccccgtctctactaaaaatacaaaaaaaattacctgggtgtggtagcaggcgcctgtagtcccagctactcgggagactgaggagaatggcatgaacccgggaggcggagcttgcagtgagccgagatcaccctactgcagcctgggcaacagagcaagactccgtctcaaaaaaaaaaaaaaaaaaaaaaaggtgaaatttaggcctatcaagatacttgggatgtaggaaaggaatatatatatatatatatatatatatatatatatatatatatatatattttttttttttttttttttttttttgagacaaagtctcgctctgttgcccaggctggaggctggagtgcagtggcatggtcttggctcacttgaacctccacctccctggttcaagaaattctcctgcctcagcctcctgattagctgggattataggcacccgccaccacgcccgtctaatttttgtatttttagtagagacggggtttcaccatgttggccaggctggtctcgaactcctgacctcagatgatctgcccgcctcggcctcccaaaatactgggattccaggcatgagccactgcgcccggccggatgttacatttattgagtacatattaagtactgctcactgttttaggtacttcctgtgcattgtcttttttaacctttcaactaagctaaatactgttgtccctgttttaaaactgggaaaaatgagcctctgagaggttcactaatacccaagctgacatagtttctaaacagaagacttgggattattactccgatgctcgcttttttgaaactactggtcacagtcgtttgtggttattggctcatctagatcaatcaattggatgaaacccagaaaatagattttgtcttcaacaataccattaaagagttgccttcacattaaaatttaataactacatcttatcctttgtactcttaatcacctgttttccctattttcttttccagatttctgacatgagggattttgtctcatttgctctaaagagtgaacctaaacattgtgtttaggtttgttattagttgctttaaatatatacacatctgtaaacattgaacttttttgatgcctcatctgtgttgcttatagatcattttccatcataattattttaaagtccttttaagaagtttaaggcctatctcatatatgtaatatattaatagtagataatcaggcctttggaagcataaatgatgtaagtaagttgggttgcagttttttcttatcaagaatctgcgtgtgtttaagtggcagtggagataatatttttatttgcgttgttatagtgttatctttatcatttagtttatattttctgccatttaaagataaaaaggttttatcttttatagctatagagtcatcttctgagccttaaaacacttgtgttttttttcttttcgccgtgtgggtggggaaaggggtgtgtggcaatggccctgtgctttgcctctgcctgagttacaggcgtgctttgtttgcctggctggggtttgtgtctcccatgctcaggagggtggaaccagtttcccagggcctgggccctacctattgtcattctccccataaggggatctgttacgtgtacttgtgggaccacacagtgctctgggcagataagcctcttcctgcctatatcagaaccaacatagcccacacacatctgggaaagcatgccagggtcagcaccccaggcgccctgtactcccagcccattccccttcttcttcccactcacctggaatccctgacccaaggctctacctattggttctaatattctggtggacagaatctaagagtccagcaagctcagaatctcaggacctcctcatccctttaggaaccatcaattaatctcatgatttcaggttgaaccactggagtcaatttcagaagttttggtctatctcagaaccttcagatcacactcaaaagcttggggacagcctcagaaccttgggacacatctcagcatacagggtcatcaatcttagaacttgaggtctgtctcagaaccttcatgcgaaactcagaatcttgggaagtcccaggaccttgtgcccggtattataccattggatcaattatcacagtcgcagaatcttgaggtccatcttggaatggtgcagtcagcctgaaccgtgggatcaagttcagggacatgagaacaatctcagaaacttctggccagtcctaggtctgaaaaccttcaaaacagcaacagactcttgcggtccatctcaaaacttgagattgtggtctaaaagggaccctcaagactatccatccagtcccttcctggaatacaagtcacctccacagcctccctgatctcgctgtctagtctttgctatgagccctcctcgatagggatacctggcccctacccactgcctgccttgcttctggatggctccagctactaaatgatgtctccaaaatgtgagaatctgaaatctgtctcctttttcccacatcagccctctgagacctctgcagagatttcaaggcaagacccatatgctcagggtaagctttgtcccagactgcccacactgggttcctcccctgacttccagatctccacccgcccttctgaacactgttatctgcaacacagttacctgtttatgcatttcaattttgagcctataggatatctcatactgcaaaggaaaagcccattgggaatgtctggggtggaggtggatgcccaaccctgtgctgggtgatgctgggggaatcacagcaggatacagagccccagaaccccatggggtcccagaggaggagcccagaggaggaagcgggaccatacctggaggggctgcctctgatctcctcagagactaggggtgcagtgggaggagaagataggagatgcctagagaccctggccccacagagatgcctgtgagaagagggaagattcctgtttcactattctcaagagctgggagaggcttctgagagagaacctgtaatcccagtcggcccaattacagataggaaagataaggctcaaagagggctcagtcctaccccagagtggttgggtgagtcaggactaacaagtcctctttcccattcccctgacatcataactctccccaccatgatgttatgttgctgcatttcagtcttctcactggccatcttctcacattccagcttgacactaactaggaaggagagagaccatgggggtcccacacaccccatatgagccaaagtgaaaaacattgttacttttaatctcatttcttctttgtaaatgattttttgtctctgaaattctgtgacatgaatcagtttagtcactttttatcttattaaatggagagaaaaattgcttaagagatatttaggtgtgttgttttttaaccctttttggttgtaaattgttttctttctttgttttagtaaccccagaaaatctagaagaaaatctagaagagaggtaggcagatcattggtttaaaaaaagaagcccaccaactaaatcttttattgagtaaagtattgtttctaggtagagaaagattagagaattgtattgagaattttactaggtttgggatttacaaagaggctaacatgcaaaaggcagtgctcttcgaaggagtcgtatagatgtggagactttatagcccttagggagatctacagacatccgctatgctgagttctgggaagctgctttttcccatgcttgcagcctccccgtggggtaaaggtctgttagttttgcataaatatttaccatatctcattttagctagcattgcttcctcacactgttagcactaaggagaactttgcttatccagcttgaaaaatttactgtgatcgatatgactaatctggaggatgttctgtcatctttgagcattgatgaagttaaaaagtcagattggcaaaaataatgagggggaaagcaaccggttcacagttgacaaacatttgcccatgcttgttttcccatatttatttttttaaacgagaaggttattacacaagcagcatttcagtcttgtcacacccaataaattattgttgcttttatatgtttatttgtatactagtcgtttacatttgcatttactatacttttacaactgtttccttattttgtaaccatgaacaccagcttctacatgtaaagcctcattctaggtactttatatacatcatatttaatagatataataattgtacaaggcaaatgttattcccattttacagatgagaaaaaaacttagattcaaagacattgattgactagatcagtatttcccagctataaatttttttggaaccaggttttaaattcaagtcttttagcggggcacagtacctgtagtcctagttacttaggaggctgaggtgggaggattgcttgagcccaggagctccaggctgcagtgagctatgattgtgtcagtctacttcagcatgggctacagagtgagactctgtctctttaaaaataaaaaataaaaaaacccagatctttttgactcttgattcattacatttgctactgtacccaattttatgttactccaaatgaaaatattcagccaaagaaggttatttaatctattttaagataaattacaggagtaatttctaagttgtgttacagggaatatccaggacactttaataggagtgtatttttttgactcatgagccctacaacattcaggcattcaaggccaaaggtagaatgtaaaatgatattaaaaggcaaccttcagactttgagtttattattttaaaaaagatccagcttattatggaaaaatggcctaatccattttattagtcaaaaacaatccaacatttgcaatttcatgtgattcaggctaggagcaatctatcagtatgactgcgtcttaaatcttgtcaatatttgataggattctactttaaaatttttgtgtttttgtgtctcttaccttctacttctccttcactccatgtcttttttaaaattttttatgtttttgagaccgagtcttgctctgtctcccaggctggagtgccgtggcatgatcttggctcactgcaatctctgcctcctgggttcaagcgattcttgtggctgagccacccaggtggctaggattacaggtgtgcgccaccacacctggctaatttttttttaagtagagatggggtttcaccatgtttgcccagctagtcttgaactcttggcctcaagtgatctgcctgcctcagcctcccaaaagagctaggattacaggcctgagccactgcgcccagcctccccttatctttttgcatgtacactttgtctttattgtcatcactaagcttttaatctttcctttgttaccccatctaggtcctctgctctccctcaaccttttacttatttctggttgagcccttttgtcattccctgcaattttctgaccatgtagtagatacccagtaggcttcctggattacttggtttttctgtattttgctaaaaagttactccaaagatgataccttctatttggacctttcccaccctttatatacctatctaggaggtagtaacccaaccattaatctctccatgcaaaatacatgtattgactaaaaattatgtgctaggtactgtaatgtttcctacccattattttacttaattctcacaattactctgtgaggtattcacaggtgaagaaagagaaagtttaagtagcatgcctagtgagtggtaaaacttggattttagtatgaatctgtctgacttcccaacctgcactgtttttttttttgttttgttttgttttttttgagacagtcaccctctgttgcccaggctggagtgcagtggcgtgatctcagctcactgcaacctcagcctcctgagtagctgggactgcaggcatgtgccaccgtgcccttctaatttttgtatttttagtagagacggggtttcaccatgttggccgtggctggttttgaattcctgacctcaagtgatccgcctgcctcaacctcccaaagtactgggattacaggtgtgagccaccatgcctggccccagcctgcatgcactcttaaacactatcctatactgccagatatggtcagagttgaatcagatactgtttctgccttttaggaacttcgagtctaatagaggaagatagagaactaagtgcacagggcacagtggagactgaaaggagaaaaatcattactttttggacagatcacagacagcttcatagaggagatgaatatatttgctgaatcctggaatgtgggatgtagttactggacaggtaagggatagaggaacaattcaggtaaaagaaacaatcaggtttttttgagacagagtctcactccatcacccaggctggattgcagtggcatgatcttgcctcattgcaacctccacctcctgggttcaagggattcttgtgcctcggcctcccaaaatactggaattacaagcacgtgccaccgcagctggctaatttctgtatttttagtagagacaaggttttgctgtgttggccaggctgtccttgaactcctgacctcaagtgatccgcccacctcagcctcccaaagtgctgggattacaggcgtaagccaccgtgccaccaaaataaggaatattaataaggacatagaggtgaaatagctcacattttcaggaactgcatatagttcagcatggctagagcatggaggttgatgatggatgggcacagcagttggtaaagttggagtgataggtggtaccagattatggaaggccttttaagtcattctaaggagtttggattttaacctctggattgtagggagccactgaaggccttcagtcagagaggcagtaagcgttatgttataaaagattctttcggtggtagcgtgaagaaaggattagtcttgagcaacagtttcaggggcagagaaaccaatagtgagacatttttcagtaatccatatgaaaaatgatactaataaattcctaaactgaagttgtaacatatacttaaaagcgaagagacaaagttattaagaagatactaagaataccagcagggtgaaaggtgtgtggtcaaagtgtggggctttctgggttgtgtccttgggtaggggttggtaatacttagcaagatagggaatgtaaaagggagaaggcagggttttgttttgttatttttgtttggctgactgataagatggaagatggagaagagaacagacatagtaagggatagatttagtttaagttactaaatctttagtttaagtattcactatctgttgtatgatagattatcccaaaacaataaacttgcactatccactatggtaaccacaagacaaatgtggctatttacatttaaattaattgaaattaaataaaattgaaaattcagttcctcagtgacactagccacatttcaaatattcactagccacatgaagccagtggctacagtactgttggttgatcatagaacgttttaaattattgcaaaaagctcttttggacagtgctgccaaacatttatcaacgcatagtttactaagatcagaaatcggtgagcaactttgctgggtggttctgcttcaaggtttctcatgaggttgcagtccaggtgtctgcaactagaagcaagggcttcaggaatctgaaggctcaactgcacctggtgggtccatttccaaggtgacttactcatgctggtcaagtgagtgctgattgttggtaggaagccctagctcctctgttggtaggtggacttctctgtggggatgtgtgaggcagctggctttgccctgagtgagtgattttagccagagagggaggtagaagccattataacttttgtgagctgacctcaaaagtcacactacatcatttctataatctgttggttacacaggtcagcactattcactgtgggaagaaactatacaagggcatgaataccaagagtcaatggggcccattttgtttttttgagataggatctcactgtgttgctcaggctggggtgcagtggtgtgatcatggctcactgcagcctgaatctcccagcctaaagcagtctctcatctcagcctcccaagtagctgggactacaggcatgccaccatgctcagctaattgtattttatttttatttatttatttatttttggtagagatagggttttgccatgttgcctaggctggcctcaaattcctcggcacaagtgatctgcccaccttggcctcccaaagtgctgggattacaggcataagccaaagtgcccagcctattggtggtcattttggaggcttcccaccacaaatacttacggaatatctgggtacaaatatctagtggacaactaaatgtataggaatgagttcttagctagtgctattatatttgtgatggtagttgaagaaacttgaataggtgtagatcaacaaggatgagattgaaccagaaagacagttaatatagtatcttgggtcacatgtttggggaggacagaagtactttcaaaggctggaggaacagctacaggggagtagtagtagaacaggcaggggagtacattataaaggaaacttgaagggatgaaagttgaaagtagaatgtaattaacattgttcagtagttaaataagagtaaaacttaacagagtcattctttcaaaaaatatttcttgaatacctgtgtggggaaccagagaaagattggtagataaataagaccaagtctctaataacacgtaatactatctgaggagacaagtttgggaaggtttcttggaggaaggtaatattttaaggtagagactctttaaagggtaaggaggtgagttgggtattttaggggtgtggtggtagagatatggatactaaagtggacatttcaggctatgttagatgtggaacactgctaggatatgaagttttgtgatgagggaaagtggtgagaaaagaggctggaaggccaattagagtagtcttgaatacatgcatgttaaggaacttgcctttatcctgctgactgtttcccatacttaaatttggatactactttagtgatttgccataggcttataacccctaaactgtaagttactaaacatttttctttaatattactctttattattttatttatttattttgagacaaggtctcactctgtcactcaggctggagtgcagtgatgcggtcatggctcgctgcagccttgacctcccaggctctagtgatcctcccacctcagcctcccaagtagctgggaccataagtgcataccaccacattggataatttttgtattttttgtagagatgaggtttcaccatgttgccccaggctggtcttgaactcctaggctcaagcgatccgcctacctcggcttcccaaagtgctgggaattcaggcgtgagccaccatgcctggccagtaatattactttttaaacttagaaaccatttccagagggaacttcattgtattgttataaatagaaaaccagtattgtttgctacatataaaagagaatagaaaaaatatgaatgattattacgttaaaaaaattaaaagtggaatgtagcaatgcatcctttgatatagaaaaatgcccacttggaaataagttcctcagtgagaatactatttttggtcagttagcaataaaagggcctttgcttgaatagtgtttggtttctacctaagatgagattttaaggtcattaagacaattccatttttaaattttgatgttaataagcaccaagaatcacaactctcaagtctgcgtacttggaaagatcataatacagttaatggtcaactttgtccaactttattgttaattcaagcactaataaaaattaagcccttttgttccaagaagccatctaaagtagtttatagcaggggtccccaacccctgggccagggctgcacagcaggaggtgagctgccagggcgaaagagcattactgcctgagctccacctcctgtcagattgctggggacgcattagattctcataggagtgcgaaccctgttgtgaactgcacatgtgagggatctaggctgcacactccttaagagaatctaatgcccgatgatctgaggtggaacagtttcatactgaaaccgtacgtacactcaaatccccatctgtggaaaaattgtcttccactaaatccgtccctggtgccaaaaaggttggggtctgctcatctatagaatctattcttctgagtgtgtcaagttatttattggacatctggaaatggagaagggattttttttgtctactctttgctgccatccagtttgggaaaattctcgcaaaaattttcaaaaatttcaagcatcttttacaattttcgaaatatttccagtgagtttttcagaggaatccttaactggtcctttcagagaggaaaaaagtatccagctcacctacatatctcatagttctagtttcacatttatcttgttcactttgttttgtacgtggaatacgtaaacttgtcaggataaatttaggttgttcacataagtagatatatttgtcaagatatgcttatttgcagagcctgtctcaggcatgcacatgatctcacaaactgaagatttcttccagaaatatttgaaatttttcctgcagctcaaaaggatgcatgaagagttttccactctttttgccaaactctatatgtagccccaattttgaagttacttttataaggttttaaataaatggttttgaactgtaatgactaacaaaaggcatgtgaatgatagtgctagagatgctgccaccaaagtaccaagaaagaatatcatgcttgatgataaaataaaagctttggagtgtctcaaattggctgaatacatttaatgagctattagaggaaacatggtaaagatggatggtcatttagaaattctaaagtcctgtaatgttgaggaagctaaacattatcaaatcttggaagaagtaatcaatataggaagaagaaggaggagaagcaatactttggatactaagcaatagtttcaatactaagttgaaattacttagctaacctcaatttaatggactcactacatttcctctgcagaacatgacttttacccagtgagttaaatgcttgtgtctcatggctattttgtagtgtgtctgaatgcttctacttcgtccagttgaattgtataatctcaacccgttgtacttgaattggaattagatgatttagttaaatattatgaaaactgaaaactgatgaaatctgagcaccaaaaagaaagttatttctataaacagtgagttgtgtgtgctttggaaataagagtagagacttgtcactgaaaaaaaattctgtcaaattagacgtgtatacaaaacaattattatttggaaagtatcttctagattattatgaatgtctttcgtttcttgctccactctaaggaaacaggaaataaatcatagctgatatattttaggacagtttataccagaaagctgatgggacactccaatcaacagacccctacttaaagaaacagccaggcgcagtggctcatgcctgtaatcccagcagtttgggaggccgaggcgggcggatcatgaggtcaggagatcgagaccatcctgactaacacagtgaaaccccatctctactaaaaataaaaaaaattagccgggcgtggtggcaggcgcctgtagtcccagctacttgggaggctgaggcaggagaatggcgtgaactcgggaggcagagcttgcagtgagctgagatcgcaccactgcactccagccttggcaacagagcgagactccgtctcaaaaaataaaaaaagaaaaaaggaaaaggctttgatcctacattttaaaattggcaaatgaatgtacatttacataagttgaaataaagtttaaggtttgtatgaatggtttttaattatttcctgctttaactattcttttccattaaatgaccaaccactggtaccagtggattggataagacagttggcactgcgtggataaaggaggtttaaagaaaaggaaacatgaaatgccttctttttgaggctgctacaataaccaagttacaagtgtgctgattaatttattattcctgtttccagaaatgtcttatttgtatttcatttttaatatttttaaatttaatagtttacatttcccccactagtgttgccttctatttgtagcaagttaatactggttttctatttataatagtgagataaagtttcctttggaaaggaatgttacctttaaagaaaaacattaggtgactaataatttggtgcttatgtgactgtggcaaatcatgaagatagtattttaagtatggaaaacaattgctaaccagcaagataatgtcaagttccttaatatgaactcacttcttggcctttgtctaccttctccagcttcatgtcttaccactttcccttattatggacttcatgttgatcaagtggaggctccctctcctcaaggagagtccctaggccagattcagaagatggttggtagagaggggatttgatagcttctgaggacagtgctttggatggagaaatatcatgcaacttaggacagtgctttggatggaggaatatcatggaactttagttttccagctttattgagctttgcctgtgatattcacttgtttggggggctgtttggagacagggtctcactacattgtccagacacaatcaccatgtactgcagccttgaagtcctgggcttaagtgatcctcccatttcagcctcccaactagctggaactacaggctcgagccactgtgcctgactcttactcacttttttgttcccaatacctggaagaagatcgtcagtctgtaaatatttgaaatctaaataagggttatggtgctgtagtataaggccaaatcttgggcaccaaacaaaaaaaaatttagaaaaatcccttagcccatcccatgctgtgctgggagcttcatctttctttttaattgcaatttaaacgatctactgctacaagagggttgtggtaaagcagaatttcttatactgtgcaggtgggcatgtaaattggtttaaacttacagaaaataatttgacaatatagttcaaaagcctaagaaatgtttaaactttttgaattagtaatgccaattttggtatatatctcaagacattaaggatatacagttttagctgtcattttatacaaagagatcacccacaccattattttagtaggggcaaagaggaaccaatgtaagtctggtgcctctgaagaggtagacctagaaactgggatgacaaggaactcccaggggactgctgttaataaattactttatgtcatttgataaaatatatgtaagcattaaagacattttcaagtaaaccttagtgaggaaattgttcatgatctgtgaaaagtatgggataaaacttcaaatataatgccagttacatttttaaaaaacattcatgtgatgcttttaaaaagacttctaggacatgtaccaattttttttttttttttttttgagccaagtcccactttgtcgcctaggcttgagtgcagtgggcacaatcacagctcactgtagcctcagcctctcaagtagctgatactacaggcacacaccaccatgctcagctaattttttaattttgtgtagagacaagctctcactatgttgcccaggctggtctcgaacttctggactcaagtgattctcccacattggcctcccgaaatggtgggattataggcacgagccactgaacctggcatgtactactttttaagtgtttctgggttgtgagattatagatgaattttgttttattcttcacactcatatgttgttttctaggcttttaactatgtgtatatatatatattgcctttgtcatgagagacacttttgtttttaagtgaaacctctgtttagtttttatttatttatttgatctttattttaatggaaaggtaactgtgctggtaagctgatagatgattggaaggaataattcttgagactaggaatgcaaatgaaagactgctgggagatatgagaagctcctgaactagggcagtggtgataggattggagaggaatatcgtgatcagtaagacataggaataaaggaaaaagagggatccaggatgactcccaagtttctgggtgtttaaatgtaatacatttgagatgaaagtttggctcttaaaaaatattcttatttggggaatgtttaaatttagtgaggtcattaacaacttcagattccttttatacttcaattctttaaattctatatgttgccaaagatcctacttctaatttgttagggttaacaagaagaaagatgatatgtctgtgaagacatgtttctgacatctgtcaccctatggattgccagttgatagacctggttgtcttgataagtattagctgactccccaaccagtttatttgcaccacttctgaagcaataagcttggttgaaaaagggcacctcccaagtagggaaggataatttttaggtcaaattatagaaattgcatgtatccctgttaacacttccaacaccaacaaaaaaatagacaggaaaatgaccctaccagctaattctccattataagactttgaagaaaaggttccattaaaaacagaaaagaggctgggcatggtggctcatacctgtaatcttaacactttggaaggccaaggtgggagaattgcctgagttcaggagtttgacaccagcctgggcaacataacaagaccctgtctctacagtaagtaaaaaattactggatgtggtggcatatgcctgtggggccagctgtttgggaggctgaggtggaaggattgcttgagcccaggagtatcaggctgcagtaagccatgattgtgctattgcactccagcttggtgacagagtgagaccctgtctcaaaaaaataaaaccttgaggacccaaatttgatttaaatttagatgtactatctgctttgggagagttactttattattatttagtagagacagggtctcactatgttgcccaggctggtctccaacttctggccccaagcagtcctcccaccttgggctcccaaagtgctggggttacaggcgtgagccaccaaccctgcccttaagttatttttttgatcttttcatgacatgctgtgggcaataaaataatacagtgggtgatctgttgttgcaattcaaatatggagttcctttttcttccacaaaagtattggctgatttctttctttttctggctgtgagcaacaggtaaattaacatgaccatggtctgtccccagcgtcttgactcagatttcttaatttgaacttttccatcttctccactccaagatcacatgacaacatccaacatcagtggatagaaataattagaggctggatgaggtggctcacgcctgtaatctcagcactttgagaggccgaggtgggcggatcatttgaggtctggagttcaagaccagcctggctaacatggcgaaaccccatctctaccaaaaatataaaaaattagctgggcgtggtggcacacgcctgcaatcccagctacttgggaggctgaggcaggagaattgcttgaacctgagaggcggaggttgcagtgagccgagattgtgtcactgcactccagcctgggtgacagagtgagactccatctaaaaaaaaaaaagaaatttaataagtcactgctacactggcaaagaagggttgagtagttttaagaagcttagttgctgtccaacagtcttattgcatctgattcttttggtgcttgcttactcaagtagggatcacatagcatgggaaggaaagagcagatctgtgattctgttgtttacatctcagaattgtggtttgtgaatagttttgaaatttttcttatagttttgggagaaatttgttaacggaatttttaaggattataggacagcacaaaataatttctcttgtttagatgcttttaataataaaaaaaatctgttaggatactttttccttttttttttttttttttttttttttttttgaggtggagtctcgctctgtcgcccaggctggagtacagtggtgtgatcttggctcactgcaacctccgcctcctgggttcaagcgattctcctgccttagccttctgagtagctgggattacaggcgcatgccaccatgtccggctaatttttgtatttttagtagagatggggtttcaccatgttggtcaggctggtctcaaactcctgacctcatgatctgcccaccttggcctcccaaagtgctgggattacaggcgtgagccaccacgcccagcctagaatactgtttaaatgataaaatagctgagtgcagtggttcatgcctgtaatcccaacactttgggaggctgaggcaggaggattgcttaaggtcaggtgtttgagactagccctggcaacgtagtgagaccctgtctctacaaagtaatttcaaaattggctgagagtggtggcacacacctgtagttccagctgtttgagaggctgagttgggaggattgcttgagcctgggaggttgaggaggttgaagctgcagtgagctgtgatcgtgccactgcaccccagcctgggtgacagagcaagacctcgtctcaaaaataaataaataaaagataaaataagaccgaaagatttcattatgggatagagaagaaaactaatatggaatttaagataatattcttatatttgagtggcctctttttttgagacagggtctcactcttattgctttggctgggccacagcggcatgatcttggctcactgcagcctggacctcctgggctcaagcaatcctcccgcctcattgtccatactgtctagctatctccatgataacaacatcatcttatatcatgactactgactaaaatccttagtagctgggactacaggcacatgctacaatgtctggctaattttttaattcgtttatagagatgggggtctccctatgttgccgaggctggtctcaaactccaggcctcaagagatcctcccaccttggcctcccaaagtgctgggattacagacgtgagccaccatgcctgacctgagtagcctttttatttaaagggaatcggcatttgtttattacctggtatgttctgagtatcaggctgtgtacttaacctcacttaatcctgacagcattcctataaagcagatacctaacaattatttgtgaggaaattaaggttcagtgactttccataaatttgcttatggtcacacaatccattgagtgcttgtgccaggttttaatctcagtctgaccaataccaaaactcattttttctatgtatgtttcccttttagaaagattttatttttttaattttaattttaattttttaacttttaggttcggggtacatgtgcaggtttgttatatcagtaaactcttgtcatgggggtttgttgtacagattattttgtcacccagttactaagcctagtacccaaaagttattttttctgccccctccctcctttcaccctccaccctcaaataggccccagtgtctattgttccctagaaagatttcataagtaaatgtcatctagcctgtaaattatttttgtttgccagcatttataatataggtggtcattctttaggtgctgaaacagaattggttttgtccttagtgtctggctgtctccaatgataacaacatcgtcttttatcatgactgctgactaaagtactatattctcaaatcttcttttcttctttttttttttttttttttctgtgacagggtcttactctgtcccccagtctggagtgcagtggcatgatctcagctcactgtagcctctgcctccagggttcaagtaattctcccacctcagcctcccgagtagctgggactacaggcgcacacccgcacaactggctaatttttatatgtttagtagagacggggtttcaccatgttggccaggctggtcttgaactcctgacctcaagtaatctgcctgccttggcctcccaaagtgctgggattacaggcatgagccatcccactcggccagatcttttgtttttaattgaaaacttataatacatttcagagataaaggagagctatttcagaactggtgcttattggtaagttttaaagagttaaagtcagtgaactggtggtataagccatttaatcattatgtttatcattttatagatactaatcggagtaatgcagtttcaacaaaagtagtttattttggggtatacaagaatttttattctttaagctaattaattctaaatttaaaagaaggaaaacacctgagaagcttgcgctcttagtgttactacacagaagtctcaatgtagctgcaacatctgattttaaaattttcttttttcgtcttatacttggaatatttcacaataaagtaaaaagaaaatgatatacatccatgtacctgctacttagtgttatctttttgggggacgaggcaagcaaataaaaattagagatgaagtcgaggctcccctgggtattttcccccgatcctgttctcttctgcccctttccagaagtaaacatcatagtaaacttggtgtttgttgctcctatgcatgtttttatactttggctatatgttatgtatcttcaaacattatggaaatttttgcagatttttaaacttcctaacatttgaattcatgttctatattcagcaatgtgtttattaacaaaatatcaataaaaattactaattataactgttactattaataatgaatattaataaaatattatgaatatgatatgaggtagggattgagttttattctttcatgtggagaatcagtcgtctagccccattcactgtgcagtctgtcttttccctactgatgggtagcactatccttgtcatacataatgtttccattatttgtaggtttgtttctgagctttctaatcttttcccttggtttgactatttctgtaccgacaccaaactgttcagattactttagcttcataagcaaagtaaatctccttaccttgtttttcttcttcaaaattttcatcgctattcttagctttttctttttccatatgaattttgggatcagcttgtcaggttcccttaaaagttttatttttttttaacattgtaattgcattgaatatttagtttagtttggagaaaataggcatatttatgatattgtcttcctatacatgaacgtggtttttccttagaaattccagatattcccttatggtcttcaatagtaatttataattgtatccaaaagtcttaaaacttttttggctaagcttatttctaggtactttatgattttctctgcttttagaatggttggtcagtctctttctttccctctcctcctccctcacttattcttttccttcctgtttcttccttcccatcccccattccaacctcctttcattttttttttctctctccttccctcccttatcaccttttaattttatattgttttggctgacagttctatttaaggtagtgtgttatagagaaaagtatatggaacttagagtcaaaattgctggaaatgagtccccgcttcgtccttcaagaattatatgataattaagtcaacttttctgagcctaattctcttaatctgtaaaaggagaatatttacttttatactgtctacctcacagaatcaagtgagatatgtgcatgaggttttttcctaattaaaaattcagtgctaaaaagagttctttctaggggaaaaaaatgccaatttcccccaactaaaagtatagacatttattaaaactgtatctttagggctgggtgcggtggctcatgcctgtaatcccagcaatatgggaggccgaggcgggcggatcacctgaggttgggagtttgagaccagcctgaccaacatggagaaaccctgtctctcctaaaaatacagaattagctgggtgtgctggcgcatgcctgtaatcccagctactcgggaggctgaggcaggagaattgcttgagcccgggaggtggaggttgctgtgagctgagatcgtgccactgcactccagcctggtaacaagagcgaacctccgtctcaaaaaacaaaaaactgtctttaaagaagaataccttaatacataaacttattattttgactcttaaagattataacccttataccccacttcctaaaaaaggatgtgaaatggtttaaagggcacgtaaacatacactcacctcagttaaagatgttaaaaatagaaaatcaagttattacagtgagatcagtgcaaatatgataattatgagggctaatacagccattgtaattaagcctctctgctttcaggattctgtgggaataaggtaaatatgatttggttctattgttggatgtatttcctcctttgagacaaacctaattttactcccattaaattaaaaaaatactgtccaccaaggtttcaagacaatattgggaacaatatctgctacaacagtttcataagtgaaagagcactttttcaaatggttttttgaatgaccgttactaaaaatctgaggggaaaacagaaagcagcactcaccaaaactgatttctttggaaaaactaaaccaaggttatttagatagcttatgatctaatttgtcaggcactgagctggtttataacctagagcagtgatgctttcaacatttttgtgttaacacatatgaacttttgaatactaaaatttttggtaatatgttgaaacttccaagggaacattagataaagtaatagtaactataaggtaaccactagtacagtaaaaatgccttctagttacaaatgaatccaaagcaatctctattttacttaacactattaagcactgcagtctgagtttgattagaactgtttactctctgatctcctctgatcttttttttttaattcaggaaccaaaatatttatatgttctaatatagatataccatctttaacattggcttgaaattatgtaatgcctctggattgtagttatttgtgcttcactataccctgtcatatactggcccagtacaaagttctttctgacaagcctttctaccagtgtgttattaactagtttgctttgtataatgcagttctgctctcaaatacatctaggcaagtaaccaaaggaatcctaggttaactttctgcatttgaaagatgtatttatggaagactgaagcttattttttatatggtaaggcaggtgctcagtttttatggggctttttttccctataatttttcaactttttgtaaaaagcagacaggatttatgataagataggcctgagttcagatccaggctctaccatttgttagctgaacaaccttggaaaagttatatagcttctctaccttagcttttgtctctttatccccaatatctcttatcatgtctacttcataggacttcagatgtgaagtttttaaaaattatcaaactgtaacttattgataattttctgcttaaggtcactctaactgaggaacctacccctagaattaaaaataaatgcacaaaataagctattaataataaatgttgaaaaaagctattccgtattaccagtataatctaaactgaaacaagattttttcttagaagtaattttttctaagtataacaatgctttaaaataaccattatataaaatttctgacatagataaaaattagaatagcttaatgaaccttcactgacctgttaccagctttagtaataaaatacagtttagattaatccttttcaaccatataagatataaagtgacaaggcccctcccctctcccagttgtttaatatgatttacctgaggtagccaccattaacttcctttacacaaatgaaatcaccccataggtgctgttttgtagcttgacattttcatttaacaatatactttttaaaatatgttttatttccatgtgagtacctatgttctgtggctatacaacattctgttctctacaatgttctatataatattatggcagcaaaacacaaaagagtgaaatgagggatgtttgttttatccactgctgtgttcccaacacctagaacagtgcctgcacataatagatgctcaatacatatttggtgaatgaattaacatctagttaggaaatgtatttctaacttggaaatgtatttctattattggtacgatattctattatataattgtataatgatttatttaactagtagaataatgatggatggtaggactttgggtttttttcacctttctatgtttttttcccccttctatgtttttttcccccatattctcttcagggagcaactattatcttgataatggtggcaatttaagaaactactttgagaaaataattaaaatatgaaaaatggattttttgtttttgtttttgagacggagtttcgctcttgttgcctgggctggagtgcaatggcgcgatctcggctcaccacaacctctgcctccaggtttcaagtgattcccctgcctcagcttcctgagtagctgggattacaggcatgcaccaccacgcccggctaattttgtatttttagtagagacaaggtttctccgtgttagtcaggttgggctcgaactcccgacctcaggtgatccgcccgccttggcctgccaaagtgctgggattacaggcgtgagccaccgcacccggccaaaaaatgtatttttatggacacccatagctaaatgtctttccatctagtggctggttaaccaagcatggttcctcctgtttcctttccctatgatcatttcagagtataaccattgtttagtgtaggagagatgttatgacttttagatatgctttttttcataaaaaggaattgcctagttagaattttttaaagatatctcacagttcagcagttttgacattgctggggaaattttatccagggatacagaagaaacgttcattcatttttatttaagcacctataaaaagtaggggggtacttctggcaatacagttgggttactgtttgtggctaaatatgtgtgtgaacattacgacatttgatgaaaacagcttcattgagctactgagctctccagctgatttttcttcttggccttaaaggtttacaaggctaagaatcaatctcctctggggtagatggccttacggattttaaatatgtgttgtgataaaagtgattttactctaatacagcatagtacaagttaacttccagtatgcagaattgacctcgtgaattttagtttaatgatctcagttctcatgaacttgcaaacatagaaaaaaaataaatatttttaaaaaacttttctttttaaattgtgaaaaacgtatatgatggttacagcaaagattatgcttttatgactaattcattacattgagtcatacatattaatgattcaaattactaacatagctctattaaattaaatctaccatacagtatacaggtattctgtactttgaaatttcataaatttttggatatcaactctcagaagggtatactagtaatttgcttttacccacaaaatcttcagatttgtcaacaaaatgaacgagattggtattttcactttagtttctcagtgaaaataaagaatgggtagatgaatggtccaaagagctaagagagaagacttaatttaaactcaaataaacatgcccagaatgaccctctctttttctgcccttcctcctgccacagttagccactgtatgtctcaggttttaggcaaagtgagtcttcttatcatggaaactgtgaacattcattaacaactggttttactttgaaacttaaacagcaaacaccaaagagtgaattgttggtataatccatgggagtcttgagattgacgtcagaacaccagtacagctgtataagcattgggaagtatttttaacatccgtgttagatcatctttttgacctttccttttatgttttctctttttccattaaatggttaaaaaaaagagctttacaatattttctaccaacactgtaatgatattcttaaaaaaagcacccgtacaattattttctttgttcctttcccctttgcaactttcctttacctgtagtgttccaagttctgatggggtggcctttttttttttttttaaataaaaagtttgtttttgagaacagggctagatttgccgaaaatgagaagctagaaaataacatataccccataggcatgctcagagtcccctattattaacatattacatttgtgtggtacatttgttactgaaccagtgttaacattaatattaattaaagtctgtagtttattcagatttccttagtttttacctattgttctttttctttcctcagaaaccacattatatttagtttgtcatgttccttagcctcctcttggctgtgacagtttctcagatttttcttgttcttgatggttttgacagttcaaatgagtactggtcaggtttcttgtaggatgcccctatattagaatttgcttgatgtttttcttacgatttgactggagtatgggttgttggaaggaagatcacagaggtaaagtgacatcttcatcaactcatgccaagggtacttaccgctaacatgatatgtgactattgatgatgaccttgatcaccaaaataatgtttatcagatttctccagtgtaaagtattggaatgttctggtaggcatatcctagttaggttaattgctctggtaattgcttgggctttagttattaaataaatcatcatattggtatactgctcattgaaatgttaaatttttttttttacaaataatgtgttcagagttgagaattagattttttaaatgttcagattgtattttcaaattgtatttttgaaataaagctttcctttcctgtcgaattctaaagattttgtttatctaagggaacaacttaggttcgtattttaagtaggaagttagagagcctggtcagtttatctgcaatttaaattctagacactgagacttatttccttcattttatcttttaaaaaatagactgagatataatttacatataaaattcaccattatattattgttaatttttatgggcataagtatttatatttatggattacatgcaatattttgagacagggatacaatgcatgataatcacactaaggtaaatggggtatctattacctcaagcatttattctttctttatgttacaaacattccaattatactcttctagttatttttaaatgtacaataaattatggttgactgtaatcactctgttatatcaaatactagatcttattctatcgaactatatttttgtatcctttaacaatcccaacttccccaaccccccactacccttcccagcctctggtaaacatctttctatctccgtgagttcagatgttttaatttttagctcccacaaatgaatgagagcatgtgaagtttgtctttcggtgtctggcctatttcacttaacataatgaccttcagttctatttatattgtggcaagtgacgggatctcattgttttatatagctgaataatactccattgtgtatatgtaccgcattttctttatccatttgtctgttgatagacacttaggttgtttccaaatcttggctattgtgaatagtgcatcaataaagataggagtgcaggcctctttgatatactgacttccttaagttcactcattttaagtgtgtacttcgatgagctttgacaagtgtgtatactttttaaccaccacaaccagcatagttaagatatataacatttccatcaccccaaaaaattgtctctgctttctgtcacaatagttttgccttttctacttcatgtaaatgaaatcatgtacagtatgtaatctttctgtgtctgtcttctctgtctctttttttttttaaagacagtctctgtttcccaggctggctggagtacagtggcgcaaacacagttcacttcaggcttaatatcctgggctcaagtgatcctcccacctcatgctcccaagtagctgagaccacacaggtgcacagcaccacacctagctaattttttagtattttgtagagatggggtctttctgtgttgcccaggctggcctcaaactcctgggctcaagtgccctgacccctgcgaagtgctgggattacaggcatgagccactatgcccagcctttcttctctttttttaggcttaatacttttcagatgcatccaaattgtttcatataatggtagtttgttcctttttcttaccataatagtattacattgtgtgaataagtcagtttctttatccattgacctgttggtggaggtttggattgtttccagtttttggctattttgaataaatctgaacattttcctgtaagtttttgtgtggcatatatttttctttctctttggtaaacatctcagagtagaattgctgagtcatatggtaaatatatattaacttttaaaaaattcttttatttatttttttagagatggggtctcactatgttgtccaggctggtcttggatcagccttggttagggatcctcccacctcaccctcccaaagtgctgggattacaggcatgagccaccacacctggccttgattaactttataagaaactgccaaattgttttccaaagtgcctctgtcattttacattcccactagaaatgtcgaagagttttacttgttctacatcctcatcaacacttggtagtatcagtctttttaattttagtcattgtagtgggtgtgaatggcatctcactctactttttatttgcatttctctaatgatgaatgatattgaggacttttcatttgcttattgaccttttgttctcttttgtgaagtgtctgttcaagtcttttaagaagttggcttgtctttgtcttattgagaggtaaggtatgggtcctttgtcagttacatttagaaaatgtttttctttctgtttgtggcttgtccttttatttccttaacaatgtctttcaaagagcataagttattaattttgatgaagttcagtctatcaactttttattttgtattcatgcttcttggtccctatcgtaaatatcttgacttaacccaaggttgcagaaaatgtcctcttaattttttctagaagttgtatagtttagctcttatgtttaggcctatgattcatatcaagttaacatttgtatatggtgtgaggtaaggattaaagtttgtgcgtgttttggcatgttttccagcaccatttgcagaaaagactgtccttttcccgttgaactgctttggcatctgtgttaaaaacttaatagactgtctgtgcatagttgtatttatggtttctttattatgttctgttgatcaatatgcctgaacatattgattgatttattaccttagctttaagtctttaaataaggtaatataagtcttccaattttgttgttttcctaaaaattgttttggctcttctagatctttgcatttccatatgaatgttagagtcagcatgtcaatttctatttacagaaaacaggctgagattttgtggttgtgttgaatctggatcagaatgtggagaattgacatcttaaattaggtctcccaatccattggcataatctttctctccattaatttagtagtcttctttaatttctctataaacattacatagttttcagcatacagggtttgcacatggtttgttaagtttatgtgttttgaggttataaatagcatttaaaattaatttttaattctttattaataatatatagaaatacaattgatttttctatgttcatcttacatactgttactaaacttgctttttggtgctttttttatatagatctctggagttttccataatgtcatgttattaaaaagttttactttcatttaaaagatgtaagccttttatatatttattttcactgtcttactcatttggctgaaatgttaaaagaagtggtgaaagcagacatgtagacatcttttcattgttctcaatcttatggaaagcattcagtattttaccattaagtacgattttttttttttccatactctatcagtttggggaagttaccttctattcctagcttgtaagaaattttataattaacagatattgaatttagtcatatgctgtttctgtatctgtttagatgatcatatggcttttctgttttctttcttttttttgacttgccaggaggtattttcatctgaggcttttctttcttagactggtgatacagtgaattacattgatttttgagtgttaaacctacctggcattcttaggataaaccccatttggtttatcctaatggtctctttattatgtattatgtattattctttttatttattgatagatttggtttactaatattttgatgattgttcttgttcctttgttcctaagggatatttgtgtttagttttcttgtaatgtcattgccttgttttgatactgagacagtgttggcctcagaaaattttttgggaagtgtcatgtgttttcactttcatttgtcagatgtagaattgttatctcttcctttaaatgcttgtgataattcaccagtgaagtgagttttctttgtggaaatgttttcaaccagcaattaaattcactgccccctgagagtacccactattctgacttctagtaccatagactaatccttaaactttttttggattaattttttatttagagaaaagttgcataaataacacagaaaattcacgtagagttcccatataccctacacctagttttcctgattgctgacatcttacattattgtggtatatctgtgaaaactaagaaaccaaccttagtacatactgttaactaaacttcatacttcatttggatttttccagctttttcattaatggcctctttctgttctaggatcaaatttaggataccacattgcctgtagttttcatgtttccccagtctcttggtttgtgacagtttctcagtttttccttgtttgtcacgaccttgccatccccgaggactttgtagaatgccccccagtctgcgtttgctgctgttgctcggtattagactgggttatgcgtttttggaaagaatcctcttttcctctcatcaggggtgcatgatgtccacgtggcatcactggtgatgttaaccatgaccacttggttaagatagtgtttgctaggtttcttcactatactctgttttttgggaacacattactaagtccaacccacactttaggaagggggagatatctacatacatggtttgaaattcttctgtaaggaagatttggatctttccccacatttatctgtttattcagtcatttatatcagtatggactcatgtatgtttattttatactttgagttctaatgctaggtttcttttcttttgcttaaattgttccaactttggctattgggaaggttttccggttactgtttatgtccctttcatatgcccctatccttttgttttttgaacatctcctgacgtggtactagaagatgctccaggctcatcttgtattttctttgcatcagctgtagaatcagccatttgaaggaactagcattccttttatttaggaaccaaaatgtagttactaggtgtgctcattgctattggagtatcgttgcttttaggccctctcaggggacagagctaggtaatatctgtgtgaatactaacccatgtatacacatacatctctaattgtttctatatgtatcagttggcatatatgttaagttaaacatgagttgatattgatgtctctgattataatccattaccacaaggttcactctagtcctcctttttaatctgtgacttccttgtctgaccataagaaacctggctccagccaccccattatccatccacttattttttcaacctatgtacacatgaaaagcaaatttagaattattaccccataccccatgagtacagtatttatgtacagtttcttttgtcattagccttacaatttcaagtcaaaacaccgtgttccaaagtttgttaggtaagctcctttttcaccgccccttcagtgaagttatgtcatacatttgtaatgcagttagtttcatttgtcgcaatccacatttcatcttgggatcctctgacgttttggttgatgttagtggttgttgtttggttaacatttgttgaagttcactctttgtactgtgccattctgtgggttcagacaaatgcaacgggtcatgtattcaccaccctaatgtacagcgcagatcctgcaccctaaatgtccccctgtgcatcccgtttgtagtcaaacactctcctctcctctagtccctagcaactactaatttattttctgtgtctctacttttgcattttccagagtgttgtataaatggaatgatacagtctttggatttttccatgtagtaaaatacatgaaaaatccaaagattgtatcgggcttctttcatgtagtaaaatgtatttaagattcatccatgttgtgtaaattaatagttcatttgttttaaaaattgttgtactattccattgtgtggatgaatcataatttgttttttcattcccccattaaaggccattgtagttactttcagtttttggcattaggagtaaagctgctgtaaatgtccatggccaggtttttgcatggatataagttttcaagtcccttgtgtaaatacctaagagtatgattgtaggtcgtatggtaactctgtgtttaactttcgactgcttttgttctttatagaaatggagttgtgcagtatgtgctcctttttaatctagcatctttcttttgaattgtttatgacatttatctgtatattttgagtggtcataattcatttgcattattgattaatattctaatgtgtgaataaactacagttttaaaaatccattctactgcagatggacatttagatagctctagtttgggactgttactaacagtgctgtttaggaaccttcacagacatgtatttttgtgaacatacatatacatttctgcctagttgtggaattcgctggtacagctttagctgattgtaccaagtaattttctggagtgattgtaccaatttatagtctgatcagcggatgtagtttctaggtgcttaatgtcttcatgagtactgtatgtattcattcattctatttctctctctctctcattgtggttttaatttacatttccttaaagttgagcacctttttatatgtgcattggttatttggatattcagaaaaattaagaaaattgtaaatttcttctgggctctgaaagcattggggtttggaataaggggtggcttccattaggaaaggcagtaagggggccgggcgaggcggttcacgcctgtaatcccagcactttgggggccgaggtgggcagatcacgaggtcaggagattgagaccatcctggctaacatggtgaaaccccatttctactaaaaatacaaaaaattagccaggcgtggtggcgggcgcctgtggtcccagctgcttgggaggctgaggcaggggaatggcgcgaacccaggaggcggagcttgcagtgagcggagatcgcaccactgcactccagcctgggcgacagagccagactccgtctcaaaaaaaaaagagaaacagtgtctttgggggagagccaggtgttggtgaaggcagcgtttggagtgcattctgtgaagaagttaagagtgtagtggtgtttggtttcttgtagcaagagtcctagagcagtggtccccaacttttttggcaccagggaccggttttgttgtagacagtttttcaatgggactgggagggtgttcgggggagggcagtagtgggatggtttcagggtgattcaagcacattacatttattgtctaccttattttcattattattacattgtaatgtataatgaaataattatatactcaccataatgtagaatcagtgggaaccctgagtttgttttcttgcaacttgacggtcccatctgtgggtgatgggaaacaatgacagatcatcaagcattagattttcataaggagtgtgcaacctagatccctctcatgtgcagttcgctatagggttcctgctcctctgagcatctaatgctgccactgatctgacagaagtggggctcaggtggtaatgcgagtgatggggagcagctgtaaatacagctgaagcttcacttgctcacctcctgctgtgtggcctggttcctaacagatcatggaccagtattgtctgtggcccaggagttggagacccctgtcctagagtacacagtgaaaaagtttgatagagaggggaacagtggaagattttgttagatatgtcacatgattaatggatgactaaagttttgtttggtgatctaggatgatagagatgttgagacatgaaattagttggcttcaagttctaagctgtcctgtgtgagaaattgcctcatcagccaacacaggctttgacatatgggtagcttcgtgtttcttaggatacttgggctggtcagaaagtgccaagcatcagagaaactgagacctcggtataggtggaggaagtctaatgatagccacagtcagtagcctagtctgatttgtttttagcaaatctagactattttcttaatcagtaactacttctttagtaactacttacaaggcgactgcctttgccaaggtatatgttctctgaaagctgattcttcatagatcactaactgtagttttgaggttctgtgatttccttcaaaattcacagaaccttgagctataatttatgtggatagagtgattactgggatttaacttaaaattagatgtattcaaatgttttaaggaatatgttttgtaaaacaacatgtttttcattcgttacttatatattgatcccagaaattgtgtgcctgcaaattgtcaagttgggttgatgcttcagaaaaggaaagtagaggctgagtcttcttagtatagcaatgcattttttagagcagtgtttgaggcaaattattttcgcaaaattacatggcttctagggattagattgcatgagtttgtctcttgttcctccctcattctactgtaagaggccaggctgctagttaacagaatgccagacataatgcctagggcatagtttgagacctgggaagattcacaataatcaaacacaaacagacagagtagcatgaagaaatttcaatcctcccagtcttgcttacagatttaattaggcttattggggcagaaaatatttttcctccccccatgtttaaatctgtttctcctctactcccacctcctgtcccagattctctttgaaggggtaatactagcaacaaaaggagatttttttttttttttttgtaaatcctaacttatttggtttatctggctttaggaaaaggagcagtaacaacaaccgaattttaaggtatttgagggactccattttttggcactgtatttgggaaattcccaatttaaaaatcatgctgtactcaagaagaaaattagggtttttttgtggctttataattggatcttttttgcaagtatttttaattttatgagaggtatttggcctgttctgctagagaattatcagccaaatccttgctttctttatattatatatattttcctgagtgatattctagggaaatgtatatggatgctgttctctgtctttccattagcagcgcagtgttgggcttcgaatgatgatggtagatgattgggggtgggagaagaggtggggtttcttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtaatctactgcagtctttgttttctgggtcgtgtataaaatggagcaaaatggtagaaaaatagcttcagtgaaagggatgtacctgttaacaggaataaaatagaaaggaaaaggatatttttacattgttcattattatttctcacaacagcttttaggatttttatcatgttttaaaaaacctaatttgacctaaggaagaaaattcctagttttgaaaacccgtgccttaattgcttagctttagaacaaaggtttttacatccagcattgcaaggatatctttattcaaaagaataggatgcagcattcttatgttacctttttagaactgaattggcataacctctcttgaatcttagagactttgacgtattattctgtgaattgtgatttaattatctcatgcttcaggatggttgtttccctttgatacccaagagaccatggatgggatatagggggtggggattaatattacagtgggggaagggagtgtttttacagagtaaccttcctgtttttgcattggaaactaaattgaaatatataatcattggaaaaggtggtatccatggcaccaatcttatcaacttgaattattttatcctttgttcagtttgtggtatttttgctcttgtcagctgaaatgttgattataaatttgaagaagctgccgagttgctgtgatggcactggaattgcattctgctttctttttctttccaattatagctgtaaatacaggaaccaagggatgaatgtgaaaagaagtaatataaaatgctgaagatatttttggttttctcttgaaagtatttttcatagtgagaattattttcttgtggacagaaagagctaggaccctaatttatgacattaaaaagcatttaagtgctacagacttctctatttaggaaagacagactgaaaacatgttgaagcgtactatggagctttcagttaagttgattatttccatcatggtgatatgagttatcatactgtttgccacattttgaaagctgtttgactcctcagaagtattaacaaattaacaaattcttactgagcatttacattatgctaggttctttagatgtatatcaggtttatagtctagtaaaggatataaaaaactcatgcatatgatgtaccatttttggtgcaagcatataagtattgcagtgttatatatttatgtactgacatgtaggtgttttacataagctactacatttaatcctcataacaacctagtcacgaaattattgtcattcttgttatcctatgcacattagtccaaacaagcaaacaaaaattgtcattctcttttatagatgagaaaatttacattttgagagattaagtgatttaccataagtaacaaagccatgaagtgatgaagcctgggtcagtcagactctaaagctctttccactgtttgtatatgagtagattaaagcattttatcatgattatttgacatcacaaatagtgatgccatgagtgaaaaggagatagggatcctaatctttaatctatgccaagaactgagtgattgagcaaatcatttaacatcgtctgtaaagtgtgagggttggactaggcaaccttggttcatgattctattcagtgtaagagattttcacatatggtctatggaaacaattctcattactttagtgtttttattatatttagtttccattactcatccttcataatgtgctgtacatgttggattgtgtgtggtggggggggagggtgatagagtgcatatcatcttctaacatattacatacaatatacatttatttattaagattattactgtctgtcatcttccttcttcccttcccccaaatatgtcacgaggacctagactagagcctggctacatagtatgcagttataaactaattttttgaatgaatgaataggaataatagacttgtatagtacattggcaaaatatataagtaacttcataattcttaacaccaaaagattccctgggggccaaaattattaatctttctattacagtgatcctttaaggaactaagtgtaagaatcttaaaaagaagaacacctacgaaacaatcaagtgtagtcaagtaatctgaagtttgctggaattcccccatacaaaattattggtagtatagaacttgctaaccataggtttgtttacccagtgttctatttgaaagtagtttactaaagcattccatataagcaaagaaaaaaagcagcaaagtttcttttttgtttatgtgtcactgtatagtctcaaatgctgtaaatttacagtgagtagaaaatattcagaccattgagtcttttgcttaaaagatatttcgtaaggtataacataacgtttactggtagttttgtttcatttaaacattaggcttcttgagagttttaacagttttattgaaatgtaattggtgtataataaactgcctatggttagagtataatttgataggttttgatgtatatacacgattaggaaactatcaccacaattgagaaaataaacatattcaccccaaaggtttccttgtgcattttcataatttctccgtccctccacccctcctcacctatccccaggtgtacccattgacttgtctttggtccttatagagtagtttgaattttcttgctttctttcttgtcattatagattaatttgcatgtctttttgtaagtgaactcacatagtttgtgcttttcttatgtggtctcttttactctgcataattattttgagatttgtctgtattcctgtgtatcagtagttcatttctttttattgctgaatgatatcccattgtgtggatataccacagtttatccattcagctgttgatgggcatttgggttgtttcaagttttagactattaggaataagtttgctttggacattcatgtacaagtttttgtgtgtacataagctttcatctcttaggtaaacacccaggagtggaatggctggattatatggtaggtatatattttaactctttaagaaattgccagactgtttttccaggtgactgtattgtgttacattcccattagcaacattccagttgctgcacaacttcattaatagttggttttgtcagtctttttaattttagccattttactgtgtgtgtgatggtatcatattgtagtttttatttgcatttcatctgatgactaaaaatgtttaacatattttcatgtgcctgttttatcatccatacttcttttgtggattgtctgttcaaatcttgtttttaattgagcttttaattattgggttgtaagagttccttatatgtttgggatataagtgcttttattttttttttattttattttattttgcgacagagttttgctcttgtttcccaggctggagttcaatggtgcaatcttggctcactacagcctcctcctcctgagttcaagcgattctcctgcctcagcctcccaagtagctgggattacaggtggccaccaccatgcctggctaatttatttctagttttagttttagtagagatggagtttcatcatgttagccaggctggtttcgaactcctgacctcaagtaatctgcctgcctcagcctcccaaggtgctaggattacaggcatgagccaccatgcccggccataagtccttttaggtatatgatttagaaatactttctcccagcctgtggcttgtattttcattttttagcatcctctttctctctttaatacttttattgagatataattcacatttccttgagcaaaagttttaaagtttgaattctaatttatcattttttctttcgtagattgtgcttttgctatatctaagaaatatttgcctaacccaaggtcacacctctttgcttctagttttatagttttgggttttacttttaggtctgtgatacattttcaggtagtcttttatttttaatttttgtgggtacctagtaagtgtatgtatttatggattacatcagatattttgatataggcatgcaatgtgtaataatcacatcagggtggatggggtatctttcatctcaagcatttatcttttgtgttacaaacaatccagttgtactcttttagttatttttaatgtacagttaaactattttttactataatcaccctccactacccttcccagcctctgataatcatccttctactttctgtctccatgagttcagttgttttaatttttagcttccacaaatgagtgagaacatgtgaagtttgtctttctgttgctggcttatttcacttaccataatgacgtccatttccatccatcttgttgcaaatgacaggaactcattcttttttatggctaaatagtactccattgtgtatatgtaccacattttctttatccatttgtttgttgatagatacttaggttgcttccaaatcttggctattgtgaataatgctgcaaaaaacatgggagtgcagataacccttcgatatccaggagtgtcctaaatctaaggatgtgtcatattattttttctttatttttttctcctcctgctgttccgggtctctacagtgtcccctactcctttgttttattcgcacacctgggtagtgcctttccaatcaaaggatagttgggtctgcatttcaggtctgtgatctttatgtttagggaaatccgtttcctggtcaaagcctaccagacttccttggtatcactccagaatttaacagatttggcaagtatgttttttagttaatggtttgagatcataatcatttccttcatgctcctcctgccttctatttttgcttttaatattgaggaatgctaatggaatagatttgcttttgctctctcccatctttacctggaattgaacacatatttattgaaggaatgagtggtttgcaggaatgttgccattcaggtggagacatgtttctctttaaatatatagctggcaagttgcccatatggcacatagatattaactgaattatccactgagctctgggattaggagatacagattgtgtaggattgggagttctttctattggcttatcttttcctaaaactatgtaacgggatatgaatacctttctacctaagtatcttgtcattatactagatctagttttctgagtctcacttgtgaaagcttttggttaactattaataaaaaactgtacaaagggaagatgataatggtttctcttgtaaggtggtagtccaggggttgaaagcaagggttctagttagactgtgaggttttgaatctaagctccctcttctactagttatataacttgtatatgttacttaacttctcagaacctcacatttctcttcaataaaacaaggctaaacattttacttatagaattattgttaaaattaaatgaattaatgcataaaaagtacttaaagcagatactgtaagtatgcaagtaaagctactcaagttttagctattattgtaaccattttaattgttaattattgttcttatagataatggatgatgtgtttgaagctatcacctagcacaatttctgactaccaaatgtagtttgaggcttttgagtgtttttcacctaaccattcttcccaaatgaatatttttcagggaagctaaccccaggaaatgtgacacaatttactgtattgttccttacctctataatgtatgtttattctagctggttcatctcttccttatatacaagttccacagaatgatttttttctaataagaattaagaaacctttgttctgatgatgagcttatttaaatttgggtttaatttgatagaaaattaagctgtttccttaatggggaatctggccaatcaccatcctccaccctcccagggtagaattttttccaggaattaaatagctctatctagcagggtcttcctgcctttggcagtagagcagtacaaaggccacattgagcatagctgctggggaaaccctttttccttctctagcctataaatgctgttctgtctctgtgaaaagccctgacatcagctcttggaaaaatccaaatacttgtgttagaacaaggctgaaacacttgcctgggcagagactaatggctgaactatagttctaagtttaccagattgcctctcagtattgttatgctttaaaaaacaaaacaaaaactgtaagtttcagacataatctagagaaattaggatagaaaggacaacttaatagcgcctcccattctttgctagtttcttcttatttttctcttttttctaaaaatctaccttcaagataatgtgaaattcttgcttgaggagtgagggagagaaataatatatcaatattataaactttatgcagtgttttccacatattagatgctgcataagtatttgatgtttgagacaaaataaactgtaaacagactgtacttaacttccttagtgttcaaattagatcatgatgtaaaactctccagtggttttccattatattatgaataaactctaagcctgtttctgtggctcacattcttacattagctggcccctgtctacttctgtggatctcatttcagcactactttactactctcttggtcattttctatgcttaagccacagcggactttgtatttctcaaatacattaatctgcttatcctttgtgactcttgtactagctgtttcctttacctgtaattctgtggcccacatcttcccatggctggctccttcatttaagtctcagcttaaatgcctctaaggtcttttttgaataaactaaattaatgtatttagtcaaataatatctttttttaatagcacttaccacgatttgaaattctttggtacaattatttttttgtggagtttatcttcctcctgtggaatgtaagctgcttgagagcaaggaccttatctgttcattaacgtaacctccagtgtcttgaacctcctggcataggttggtgtttgtgtaactttgtatgtacttggctgcctgtaacggaaaacacaagtcaaactgacttaagcagtaacgcatttactggctcacataaaaaagaaatctagacgtaggcttcagagatttttgatttagggacgtaactatgtcaagggctcagatgctttccatctttacactcttgccatcaaaatcatcctcatcctaaactagtccttaaagatgaatgcgaagtagctgttaaggctgcttgcttcttcactcaggttcagtgggagggagagaaagaagtttcacatcattctctcaagaataaggaaatactttcatagatgccaccagtgaactttgtttctacttttattggcttttttggaaccaattgcttacccaagaatggaattactgttaggccaaaaaggcccatcactgttgctacagatggggttggcttgacctgagtcatctggactctgagaggaatagtagataactgaataaaatcggagttctcttaaaaggaaggctgtggtttctggggtaacttatatcctctgtagttctcaataaaaatgtatggaatgagtgaattcatgtagtaaaaatgtattgaattgtcaggcgtatgctcagcaccataatagttaagtagaatacaaaatcaaatagaatgtggtccttgccttcaaataatttaaaatctagtgagagagccaaattaacggaatattaaaattgttttaaaaatcagttgattaaaataatttaaaagatgaaaaagagaaaagggaaacaacagatgagacaaatagcaagatgatagacttaaatacattagtaatcacactaaaggtaaatggtccaaacaccccaattaaatgtatagactatcagattagatgaaacagcaaagcccaactgtatgctacaagaaacacaccttaaaattaaaaatacacattgtttaaaagtaaaaggatggaagaagatgtgccctgctaatctacattaaaggaaaactagaccacattaatatcagataaagtagatttaagattatagaatatcaacagggataaaaaaagtaatttcgtactgataaaagggtcaatttaaaaagaagacatatctaggcatgtatacacctaatgacaaaacatcaaaattcatgtaacaaaagctgacataactgaaaggacaaatagacaaatctacaaacattgtcagttatttcagtatccgtttttcagtaattgatcaaagtagataaagtaagcaaggatatagagtacttaaacaatactgttggccagtttgatttaattacatttttggaacattccagccaacaaccaaatactttttttttttttcatgtttgcaagcagacatgggacatttaccatgacagacacaattctgggctgtgaagtaaatttcaataaattaaaaggattcaagtcatacaaagtatgtttcctggtcaccatggactgaaattagaaatcaataaaagatctctggaaagtttccaaatattggaaaataacacaattcttagtcaaagtggaaataaaaaaggaaatggcaaagtattttgtattggatgaaaatgaaaacacaacatatcagaatttgttggttgccattaaagcattacataaaaacttatagcattaaacacctattagaaaagagagaaggtctaaaatcaatgacatcagcttcttttttttttttaagacagggtcttactctgttgcccaggctcaagggcagtggtttgatcactacagcctcaacctcctgggctcaggctgtccccaccttatcctcccaagtagctgggactacaggtgtgccccactaattttttttagtagagatggggtctcactgtgttgcccagactggtctcaaactcctgggttcaagcaatcctcctgcctcggcctcccaaagtactgggatttcaggtgtgagccaccgtacctgaccaatttcattttaagcaactagaaaaagaagagcaaattaaaaccaaagcaagcagaagaaaaaaaaaatagagatgaaagcaggaatcactgaagcagaaaacaggaaaacagtagcgaacattaaccccaaatctggttcttttgagaaaattaataaaattattaaacctctagccagctgatcaggatgaaaagagagaagacacacattactaatatcataaatgaaagaggtgacatcattacagattcttcagatattaaaaaaaaataggggaggctgggtgctgtggctcacgcctgtaatcccagcactttgggaagccgaggtgggcagatcacttgaggcaaggagttcaagaccagcctggccaacatggtgagaccccatctttactaaaaatacaaacatcagccggcattgtggcgcgaacctgtaatcccagctacctgggaggctgagggatgagaatcgcttgagcccaggaggtagaggttgcaatgagctgagatggtgccactacacaccatcctgcccaacagagcaagactctatctcaaaaaaaaaaaaaaaaaaaaaaaagataagggagcattatgaatagctttatggcaataaatttaacaatttagatggaatgtggttggtaattttataaattccaacaatatatatacaatatgtaaatatatattacatatacataaaacaggaaaatacataaaatatatatgcactctgtgtgtatgtatgtgtgtgtaatgaccgggtagggtttatcccaggagtgcaagattggttcaccttacaaaaatcaggcaatgtaagtaaatggatggtaaatggtggtaactatgtttctcactgtctcaaaggagctaagcaagagagaagactggaatgaacctgatggaattagattagaattagagatatcagtatgaactcatgctgagcttaatatagatacagatatatggatagctacagaaagaattatagatatgttgtattagtctcttctcacactgctaatgaagacatatccgagactgggtaatttataaaggaaagaggtttaattgactcacagttccacatggcttgggaggcctcacaatcatggcagaaggcaagtgaggagcaaagtcatgtcttacatggtagcaggcaaggagagctcgtgcaggggaactcccctttatataaccatcagatctggtgagacttattcaatatcccaagaacagcatgggaaaagacccccccccttcatgattcaattacctcccaccaggtccctcccacacatgggaattatgggagctacaattcaagatgagatttgggtggggacacagccaaaccatatcatgtgtatgtataccccagttagtataacacattcatttccctgctctctctgctgagagggcctagaaatggtgacatctcagtagcagtgagcgcacccagctcctggatcttggttactaaatatcactctccaataaaatagctccttggagaaatggttgactctaaggctgcaatagggaaaatgcaagttgaacctagagtgccttatagtgccacaaacaagaaagtgcccaaacagaagggtgagagcatgtcagtggcataaacgggaagaatttgagcaagagaataaataacgtagtattggattagaactcaaagtctaaaataaacatacatgagcccatactgataaaaatgattacataaatacatgggtgagaaaacacaaatcttccttacaggaaaatttcaaatagtatacgtagattcctattcccaggagatggagcttaatcctctcagatgctagtgtggattgggcttagtgacttcttcaaagaaaaaaatatggcaagggaaaaataataactttacagggagacgtcgagcaaccactcccttaaccaaatgaccaaagttaacattactagtgttaagtcatattggtgtcatatatcctctgatgggtgatgaaaagggtacttcacccctgtggtattccaaaaatagacccacgtatatatggaaaactgattttcaaaagtgcaaaaggcaattcagtttcaacaaacggtgctggaacaattggatttcaattggatatcacactctatataaaaattattacaaaatatattgtagacctaaaagtaaaatagaaagtcactcagctcttagaagaaaatgtaggggtaaatctttgtgatttggggttaggcaaagatttcttaggtatgataccataaacatgggcagtgacctaatttccaaataaagtcccacaggtatggaagttaagacttcagcatgtctttggagataacacaattcaacctgcaacaaatataatggttcccaattaggactgctttcatgtttaatacagagaaactgagaatctctatatgagtttagtgcttttcacatactacctaagaaatgcatcttccacatttacatttagtcttccaatgtgttggtgttgtcattaacaaaatacaaattctcctaaaaatattatgaattgtagctttgggcatttattcagtttgtggatagtataataattgctattatgtgtatccctgggttttgtttgtgtgtttgttttctactttcaacacaaatagggagagagtctctctcaccgatttcgtgccacactttgtcacttgggcattaaaataattttaccctggccctttgtcttacaaggtctgttgccaaaacaagcttcttcagcttctgctgctgtttccataaagatttgacatgagttcatggaattgatctcggggacgagtgtgtcctctcttttctgtttacctagtacccacagaaactcctgtcatttctagtccaaactcccacctggattccttactataaatgaattcatcccaaggaagaaatcaagggggagtatagaacttgggttacaaggatatttgttataacattctttattatgctgaaaaattagacccagcctaaatatttacaaaagggaacttcttaattaaatagccatatcacaggatactttgcagttatcaagaattatttagaactatgttttttaaatctttatctgatttggaagttcaatatatagaatgaataaaaaacaaagcagctctgatatgtgggaagtctagagccccatctacacactcccgctctgtgagggacctcttttaaacctctagaattttatagagcacagtttaaaaccagcactgtagtgaaatatttaatatgtaaacatatgttgatattttatgaagttaaagttgtcaatatgtccagtatgctttaatttttatgaaaataaattttaaacattgtatacagaaatctatctctattttgggaaagaatgggaatatatgcataacaatgctgggtgttgggattatgggtgatttttgtttactattttgtctttagtttttaaaagtttatacgtgtacttctttggacataaagaaagtgagacatttcttcatattgaaaaggcagagagaaccattgctttataggaaactacagtttggaaaaacggcagtctcattactcaatcccttgagagaggaattatcttgaaaatgttataaaaaatattagtaacagatttactagtgtcagtggtcttgtgtgttaagtatattaggataagccacatttgtaacagctaacggagaaaacataactgaatgtcagtgttacacagtgaactttgtagagcagtgattcccaattctgagatgttgtaagaggaatgtcagaattcctaaaacactcatcctccaacctttcaaattcagtgctgtggtgagccattgttactgataagggtatatcccacttgtgatttctttgttttgggtcaagaaaagcttttgtagaagccagtgtaaaatggcatgcatataattaatttcctcatcttttcctcataaaatcagaggtccttttatcgatggtggtttgaaagtctggggtattcagatttggcagcagaaagtgtgttttttttgtgtgtgtgtgataaactaggtggattgctaattctgattgaggaattcgtaatgtttgacaccagaaccagagcacttgtgaaaagaagtctctttagtacaaaaccaaaaatttaattacagcatttgttataactatagccaataaaagtatttttaatgaaaaagaatttccgcagaagaaaatgctttctattaatgcagaaggtgttatatagaagatttaattgtaatgatattggttatgatccgttttttgttttatctttacctgtattttatattcgtataacctctaaattttacaaattacccataatacatttcttatataattaaaaaaattctgagtacagaacaggaaatatgttcaatctttattccattagagttctacttggaaagtattaatatgtaaggtttttatttctccataagaaatagacctatatagtcaggcacagtgtctcatgcctgtaatcccagtgctttgggaggctgaggcttgaggattgcttgaggccaggagtttgagaccaacctgggcaacacagcaagacctggtctctacaaaaaaattcttaaaaaatttagctgggtgtggtggcatgctcctgtggtcctacctacttaggaggctaaggtaggaggattcccttgagcccaggagttcgaggttacagtgacctatgattgtgccactgcactccagcctgagtgagagagtgagacattgtctccaaaaaaaaaaaaaaaaaaaaaaaaaaaaaagaaaagaaagataaatagatctatgtctagttaattcgaggagatggtacacatttttagagcacatgagaacgaagtttatacttttctgattttctgggtttccttgatgattttttggcaaatccttgtctgtttagctgtctggcatatgtatgactgtggttgggcttctttgtactcaaccaatgaatgcataccaactgtaacacctgaaggtaggatcatgaataaatactctgtgatttggggttagtatagttttggttgttttcccttctcctgagatttcagaaataaaagattcctattcctgtgatttttttggcacacagtaagacatatttgatacataagataagtcattataattaacttgtcgaatcactttttcttgctgcagaatgatatttttatgaatgccttaggttttttcaataaaaaatgcaaccaaactgcaaatgtactgtgatttaaagtggtaatgtcagaatttaaattttgagtagtactctttttttaaatcatagaatgctctatgtttattcaaaaaagtaaaatattattagacagtattttttattttaattttgcatttaaataaagttctcaagctcagactgaaaagtaaacactgtatgttggagcctgtctcaacgacacttaaaagctaagactttctactttttcagaagtacatttgtatcttttggcaaatgtgtagaaagcagcctgtcctaacaaattttgttcacctgttctcacttcagtttatagattgttaaacatttaatcataatatattttatatacaatatttatgtgaaaaatgcccatccttgattaaggggatttttttctactcttatttttattatttttaccagtatattctgaagtagagaaatgtgaaatgagatgaagatttaaattcctagcaaacagaatcatgcattgcccctgttttataagtaatgagatcattttgtagagtccagtttatttacatttgttaaatgatattaatatctcttccataagcatgaatttggtggtttgcatggtgttcactgaggtgaggatacttgtttaagtattttgaggatctcatactttcctagcagttctttttacttggttttctgaagtgaatatagtctttaaaaaaaagtataaggtactagtaatcagatactcatgatcacaaatgaaagtggtggagaaaccttttaaggaatattcacaaaagtgataattttccagattgtcaatgaggaaatgaaagtctctaataagctgtcacattaattgtgagctgcatttctcagtcagcaacaactaatagtcaatctataatagctccagcagagggaatgaaagtaatttagaaaaaagtttactatttgatttgtcaaagtgtgtccaggaagtaagagagcctaaccaaggggctgttgtgcatgtaagctcttcagtaaaagtggtggtgtactaagctatatttaagaaggtaatttgagattttatattacatgctagtgaatcatttttggattttgcaccagaactgagctctttggtccctgcctgtctgtggtttgtgttgcaaggtccagaggcttaaaacaaagaacaccatgggaaattctccatgagtcattccgtcagctgtagcttctgttttatagtccttcggatataactagtgttttaatgccagctctcctagccgcttttcatgctttggttctatatgctaataaaaaagtatggcagtatggctattgtagataacgttcagacttttttttctcccgattccacaatttttagttcttctaatggctctaagctagaccaattataaattgtaactggtgaaaagatttatgactgtttattttgttgtagttgcgaggtaagcgagtggtcacttaatacttttggttctgtgaatcttactgtccagagaactaaagattgaattagcagttcagctggagtcagcactatgtgctaaatccctatacttaagagctcttatgtattgcagacaaatgtcctcttagctgttttgttattttgtgaaaaataataataatagagcaaggcagtttagattcatatcagtttcaaattttaagtaccatgttttaagccattctaattgttttgtagaaacagataaattaaaaacttgatttaaatccagcccacaggatgccttaatcacctttgatattttaaaggagatgaggaaataatggacttttttgctagtaagtggcaggtatggtcaacacaatttcactacatttgaaaaaaatcactttccctgcttgccaggaaaatttaaagtgcagattgtaacctgatcttttttcttacagtgtaacgtctgagaagttcaagtattgacatgaattttctatgataccacttggtaaattaaatctgtggtttcatcactggctttgaattatatatttctatgcattttacttagctaaaaacttatttgaatatttagtctttaaatttattttttcttttctgcttatttgaatacatatcaccaacattcagattttatttttgtttttcttaatagtaaatacataagtggttactgcttgctaggcaatgcttcttattttctaatttaatccccaaaacaaatttgtgaggtataggtagatgtattagtaattatgttttagaggagatgcttaaagaggttaagcaacttgttcaagttcaaatacctgttaaattatgaaactagaatattaacccagttacatttgtttctgaggagtcttttgcccccaaggccttgaaattttagggaattttcatttatagcaatcaataatactattcccatcccaccctgtccatttctgattttcaatagtatagtttctgcactgatatttacatcgtcttacgatggttgagccttaaaattacctgcattgttgtctgatttgcaattctttgtctagtaactcttctcactggagtgggttccaataaaatggtgctgtatttcactcaaaatcaagttgcagtgttttttcctcctcattttaacatcactaaaatcagagtgtatctactaatggaattcttgataattctaaatttaataggtaacattctttgactgctaataaaatcttaaccactatccaatgtaagaaaaatttgtttaaccatctccccttcatttcaaccattccttattaagaagaaccaactacagtctcaaatgctcctttataactaagcccagggaagacatatctaacaccctagaggagagagaaaagggtatgaattaaggtttgagtgtgatatcagcatttcttctcatatggcttcagaacacttctcactgaagtattgtcaaaaggctctttatgcactgaaatcaataaaagaaaaaaacaatttctagcaggctatttattataagcaaatatgtgacgacacaaaactttctggtcctttgcaattttttaagtccaaaagaaattctgtttaacaatattaaaggactattccagttacaaaattgtgtgtttgtgtatgcttattagaataattaaacttggttaaaatgtaagtcttactctagtatacattatttattgggtaagtgttatttaactaccaaatcacatttccctctacactgtaataacacatcgggaagggccacctagggctttaaaattagaactcagaatttaacaaggaaaaggtattctgagttgagtgaataaatgtattctgaacgtttaaggcctttggttaagatttctaaaatgtagctgtgcttaatatacaaaatcaaaagtaaaggcaggccaggcgcggcggctcacacctgtaatcccagcactttgggaggccaaggcaggctgatcacttgaggtcgggagttcaagatcagcctggccaacatggcgaaaccccgtctctactaaaaatacaaaaattagctgggcatggtggcacgcagctgtaaccccagctactcgggaggctgaggcaggagaagtgtttgaacccgggaggtggaggttacagtgagctgagatttcaccactgcactccagcctgggtgacaaagcgagacttaatcgaaaaaagaaaaggaaaaaaaaaaaaggcatctagccaccatatcccagtgattcaaattcctgataattctttgctttattaatcatcgttcttcattttggaatttgacttttttgctatctgttaatagaaaaatacacacacacacatataagtaaacacagtatattcattgttgaccaagtgtccaagttatcaatatgatattttcaaaaaccaggcacagtttcattaggcacctgtaacattatgtcatagtcacatacagctgttctacataatatcgatccaaaagatattgtcatgatttcatgattagactacacagtggacagggacttaaaaatataggagttttgttcaccagaatgtatttcatcagactaatggttgaactgatttgttgcttatgacctggccactttgtagctttcagacctgcctttctgtagcagttgatagtatggattatctgatcttccttcccttctgggacaggcttttctcttttctaattcattttcttaatctcctacctccattctcaatcatgcagatgctagtttctcccccatatttgagcctgagcattttttcaagtttccttggtgttttacatttcagtgaccatcagtaggttgataactcaaatctgcaactttagccccaggctttctttgaggttctagctttctatttccagctctctgattacatctgtctcaatattcagcatgtggtagggattttgcaaaactatgggattatcttggtgactttcctagctgaagcagagagaactaatgaaatagccaagaaggttcttgacattgttacttatgcatataagcatatatatacacacatatgtacacatatatttatttgctttagcagatactttaaagtagaattcaatgattagagaaaaaattatgattttaatattatttgagacgttcttaatctatacttgaagtagtaagtagattatgataagcaagttggactgtgggcgtggtccttgttcattttctcattccgtttttgtccccatttttcctctcctttttcattaccttgtaagagaaaatagctcaggaaacgggtttacaatcagtagtctgggaacttccgggattctttaccagcatccccctggatgttgcagtccctgacgcaagcagcattgttttagggtaggagtttttataatggctgtgaggtcgagtgcctaaggttgataaatggcagttgttatcctttgcagaaactcagttggaatcctttctgtcaacttgtatgttcatctgtaaattaagaaacatgttcccattccctccctctcctacctcaacagttatggacagactgcttaggaactcctatttctgaagatttcgtggtcttttgtaaagtcagtttgttctctagagcagtgtcatcttgtcccagaaccccctttacttactaccactacttctttgtaagttaacatgctatcactgattaggaaaggttttagattcttagtctttttctatggatcaattttggtttaaataggtgtcgaagggaattgtaagtcagcttgtattttggaggttttgtttctacctccatgccaaatgaaatgtagtcattgaagtatcattgtattatgtttatttctgtctttactaataggcttttttaaaaccctagttttactgatgttcttaataaagtacggttcctattactaaataatctttacataaaatgccataggttgaaataatttaaaagacagaaatcaaaatgtaggatgatatttgagaagacttagattagcatttatatatagcatcaaacgcttatcaagaagcttccggcagtattcatttaaaagagagagaaccaggaggaaatgctgtagttctttcagcttataggacccccccagaaaaacaaaacaggaaagtgccctttgttttctacttttggaaggtattttttgtaaccgataattactttaatgttaatttttttctagataatctgttattaaatctaaacctaataattgaggatcacgatgacatagatcaatagtgcagtaatcaacacccagatattttgggaagtagtgtgaagtgatgggaaggaaggaactttcccttctaggaaaacagtgagaataatattttaatggcaaaatatttctttttgtcttgatttttaaaaatctataaaatggaaagtatatctcttcatagagatttctttttttcaagattaaacgagataatacatgtggaaataatgcatagcatttggtaagccctttataaatttagcaattgctcttattattgggatttttaaaaagaaaagctatattctaggacagctgatggtaaatgcactggcagtttaagatttaacaaagtagttaagatacttaaacatggtgttcaacttcttattcctccagcttattgattcttgctattggaaagttaccataagatttaaatctcttattctggttcagtaggatgaataaatttagtaacaaaatcttacaagtaaagtaactacatctatccttattttttctttgtttcaggtttcccctcaaaaaacctataaggtaagtttgctcaattacacttcatactcaagtttaggttatattttaattataagcatccctttgaaattatggtggatttttgtggtttttgagaatgtgtattcaagtaattcaaaatttcaaaatgttttacaaatttaaaatgtaaaagatgttactttttctggaagacagcattgttttgataatacttctaatataagcatttaaaaattttgttcaaaaggatatttaaggtcacactgaagagacttaattttgaagtctatttgtgactgttttgaattatgagtagcttaggaggtgaaaatagaatgctagtttttgatgtgttttatcacttgtgtgactataattgcctttagttaatgtactttggtactagtttagtcttaattactttattttttattttattttattttattttttgagatgggatctcactctgttgcccagcctggagtgcagtggcgcgatctcagctcactgcaagcaccgcctcccgggttcacaccattctcctgcctcagcctcccgagtagctgggactacaggcgcccgccaccacgcctggctaattttttgtatttttagtagagacggagtttcactgtgttagccaggatggtctggatctcctgacctcgtgattcgcccgcctcaggctccgaaagtgctgggattacaggcgtaagccactgcacccagcctagtcttaattactttaagacagtgaagaaaaaaatccaaaatgttaaaatgtatctatgcctatatccatgtctatatatttattcatttccaggtcttaaatgcctcttcctcagtatttttgctttcagcatttcttctgttatcttatcataaatattatttaaaatgtaggtagtatgtcattcctaattattatattttatcatttttagtgtcagcatagtccaggatccaatgctaaccttggcatttcagtgaatatgtgtatgtgtacatatgtattattgttatggtcttgtcacccaaccattatctgatcagtgtaattggctaagccatagaagtaataataataataatgtcattggtccttaaagtggttggctaagacttctgtggctagaactacatcagcaggcttaaaatgaggcttgcctaaggctgctttttaaatgttaaaccgttctcatgcatgctctatttatgcagtgattttgaacttgatcatagtatatgtagagttggagaatgggtttaattccttttaggcactgtgttttttttgtctgttaaatggaaatgatagtattgacctgtgaaaaccacacaaaaaaaatgtaagcagttacttctgagaataaaagagactttaatgctgaatactatttttaattattttaagcagtttttataatcaagtaaatagactgtgtataaccaaaacttattgaaaaatgtaaattagagaggcttatggtgctgtgtaaagtaaactgatttcctggtttttcttgtaagatccacttttagaattttaaattttttattctaatgattttcttgcactaagcatttgattactttgctttaatttaggcatggaagtattttgaaccgagagtcaccaacagataagaagcagaaagttgagcgcattgcatcacatgattttgaccccacaggtaaaacactattcattctttcaaagagtattgagagtagtgaagttcagaataatagagcttaagctacccgaaacactcaggaatagttgtttgatctgttttaggactctcacattcctccaattatatcataataaagcctttgcatttagtaggaatgcaagcatttttaacttccaacactgtacattccactacagaagtatcattgtagagtatattgtatctttaaatagtgataataatagaaatggttatataataattggagatttggtcagatcaagaactcagtgttaagttgaatcatggtataagcagtaatatgtcataaaaccaaggctctaacaactcgacacttgcgtagtcatctaaaaattcaattgtgattatggtgaattggagttttagataaatcagtttcacaaattaatgatggtctcattttagagtaaacaaatgaatagaaatccctttctcttcagtcaaaaagtattctgaacttaaagagctgtctttcaacctaagcagtgtcgatctttcctagggttgtcaccttaacagactttcagattgatctccttttaaaacatctaggctttttccttttgctttctccttgtaagcttactccatatttgattcatagaaagtgcttggtaatcttgcttttttcatttgaaactgatatatattttttgtgcacatactattttattcagttgcctgtccctttgacaagagacgaagtaaatcccgctatctcagatacataaaaataatgtatctatttttaggtatttttacttagaaatataattttaaatatttaatagagaatagtatgttttatttatctaagacatttcatactttattagtataaactcctttattttgaaaaaatattataaatattatctaggaagcacatagataatcattttctgcattttgggtagtaggtaaaatgaaattccaatcatcaatttaggaggctttggtggtgggactatgtattatgtcacttacagatctccatgaagagagaattttccattctgatgcctaattttgtagtcatggggctcagaggctttcatttacatgattaggtattgtcttgccaataaggtcaaaagtttctgccctatgttcagaaaaatataatcttgttaggtttattttgtatctacatctgtgctgtgcccatctccaaagacagatttaagcaaagatgtatacaatgcttcataatgagatcattatagcttttagtgcttttgtcatctctacaattatcaggtgatatattttgtatactattcatgtgttgttttgtttgaacatatttttattgcactgtcttttcttcgataaatctttaaaatatgtcattacctgtgctgtttgtgactattctaagtgctgtcatctgttatgttcatactttgtgtttgcacgatttaacttgatcatgattcattcttttttccccatgaatttttccccttacattgtctccatattttctatatctctctccttttctcccgctcttgtgcagatagctcctccaagaagacaaagtctagttcagaggagagtagatccgagatatatggtaagctaatgtagctaattcagccttgccctttggagcttgcttcatggtgttccttttctgttctttttttcctttctttctttctttttaaataactgcagcctttcttgtgtctgctgtgcatggcatgatctactgcagggaaagggagcctggggttttaacgtggctgtgatgtggaagcttaaggttgctagaaactaacattgtagattaagagtaggccacattgcccatcttctcccgtcttgtttatggtaggaaggtgattatctctaatatgtttgggtcaggttcctccaaataacatgaatgggctttgaattcttgtcatcttcttcccacatctcatttgcagagtttggattatgaagaatttgaggaattaagtcttttcctctaagtataatactggtgtaatttagacgtattagcagttctttggaatttttatttcattttttgtttgtttatttttaattgcctcgtcatgtggaaaagtcattcttgtataatttatccacgatggcaaaaatacgtaagtattttatcttcatagcttgaagaatttgtgcctttgagaagtttctctgaagcttaatcggaatgggaaaatttcagaatggtaccttttaaataatcttaacaaagagcaagtttaacctgagtggtcaacttttgcagcagatgattgaaatgctaatatttctagactgtgtcctgtcttccaaagatacaataaccatgtttgtgaagttcatacctatttttccttttcctttgcagttttatttgccctctttccttcttttggagtctgattagggttttgttttggggtttttttttttttggttttttgttttttgagaaaagtgaataagagaggaattacctggagctaagattttaaaaataatttctgaaagactgataaattatttctttttttaggaagattccaaatttggcctcgaagggaaatcaggtcatctttaatagagccacaaatctatagagcagaagctcccccaggtgcagatagatgtttcctagcttgatatataggagaggaaaaaatacaggaattgccctcccctttttaagacatttgataattcacatctgctggcacttgagcccatatcagatactttttagtattatgaaagctcagtgtttggttctaaaccagttaattcttctatgttagatatatacacatagttctttacttgggtttttgtgaccagtgctttttctgtgtataccttttacagtagttcagcagtaaatgtatactgtgccttgtgacacatcaagtttacgctttttcttccttccagagtattttggctactgataagtaagaactacctaattcctggagactatatttctgttctatataaagagctttctatagtttatcctctccttaggaacatgaacattatctttatagctctattctttttcggtagcctttgcagtgttctatttcgtcttcctctccattttcctagatctgcgatgtgtatttagaagcttgttgtatgctttggatgaagactaacaatttaggaacctctgactagaaatactatactaatatttttcttagcagtgatagaaacattaatactagttcaggcatgccattggcttggtagtgatagaaacattttaagtggtaattgggaagtaaggtgtggcttctctgtgtgtttgttttttgagaacccttgaaataccttttttggaaggaactgagtccacaagtcctcaaaaagcactcatcggagggatgagttgattagaacagaattagcatgctaacgtaaatctctttgacattacaaatattttatcacctgtgtgaatagacgtctttagattacgtacagttagcatagatgaaaaagtctctctggggattcagaaaagcttgaaactactgagtagaatcatagcaactggtgacattctgctttagtgtagggtcttattataagcccacttcaaactttagagattatacattgctttctcggggtaaaattcattagctgagtacttaacaaaaatgctagttactcacatattatttattttaaactttcttggcttttttttttttttttttttttttttgagacaagatctcgctgtgtggcccaggatggagtataatggcgggatcatgactcactgcagcctcaacctcctgggctcaagtgatcctcctacctaagactccaaagtagctgggactacaggtgcacaccactgcacccagctgttttgtttgtttgtttgtttttttaatagagatgaggttgttgaaggaatgatttgccaggggaaaaaaaaaaaagaaagaaatagtagagacaaagtctcgccatgttgcccaggctgatctctgtctcctgagctcaagcagtcctcccaaaatgctgggattaaaggcataagccaccgcacctggcttcttagccatttttagagctactttgtgaactagatttactttgtgcatcttaaaaggaaaccaagtgtttgctttgtattgactttttttgttacatttctgcccagtgcggtcagttggttatttattccatttccccttatttgtccctttctacctgttagagtctattaaacgtgtatggatgcgttttctgatctacaattttaataatacttaattttattaatacttttgtgggttactgtaggaaatgagagattcagcaagggaattctgagttagaccatagctgctgcttaaccgctgtcatggtgtctgaacagattcctgctaacagtatttggttcaagaaaataagttatgtctttttaaagctgtcttagtgtgttcaggccactgtaacaaaataccatagactgcttggtttaagcaatagaaacttattttctcacagttctggaggttagaagatcaagatcaggatgtcagtgtgatcaggtcagaagattcccttgctggcttgcagatggctgccttcttgctgtttgtctcacatggcctttcctccgtgtttgccaatgccctttctttagtttctatgatattacatcaacctggttctttattctttgtaattattttgtctctctttatttgattgttttttccctcctgttttatacatgtaggcatgacccaagtttctgtccccaatctttcttccagtctccagtctaagtgtcccataaattcagagtgaccaaactggagttcatcattgttctctacagctggaaatcagtcttcctctttatttccctaattcttataatgacactgtcatttttccactcacctagtcttatatttccttaaagttatatttgacttctccattttccgtcgtcccctgtggtcagctatttgccaggtccccttgattctaccatcacaatatttttcatccttcactctttggtttcaaccccactgccttgtccatcattttattagactattataatagattcgtaacttacttttatttcagtttcacattgattcattaacttttctccattctatattctgccttgacttgtcagattaatattactaaagtaagaatttggtcattcacttgctaagaaagtacaggtagttattaagataatgccacaatttgtttccaatttattctactctgattctccttcagcgtttcattttccaaaacatgttttggcattcttcctttgcacatgccatttctgttgtcttgagtgaattaccacctataacttagaatcctactcatctttcaaggcttaattcaagtactgccttttcctaggattgcccagctacttttgttgtttctgaatgttgacatctgttttgtatttaattacttatatttatgtttatctttacatctcccataatgctgaacatattggagacactcattaagtgagttttgaatgaatgattgttgagattgacataggaagtattttagtagagaaaattgatggaataagatcttcactcatcctaattgaatctttctttccttctgaaaaacttgaagatagaagaaaatgtaacttggagacatttttctggtagtggtctgaaagaatgaaatcagcatacttggaatttaaggctcttcttgctggcaagactgtgcatttagaatcaagaagcttcttaatcaaaggattatctgaggtcttactcataaaacatgtatgtctggcaccagtttaaaatgagctgtttttatgaggttgcacatggcccttctccactcccttccctgaagctgattcttaagagctgaaacctagagaagtttggtcatgaaataaaataaaaggtgaagaaagactaatgtgctttcactaaagtcaatgtaatatggaagatttaacaggttatcttacatgtttaacactccattttcattaatatgccccacaccctattttcattataggagttatggccttctttcaggaacagttatagaatgacacttcatttttttttcactttcaaaatatgatcattggtaattatctattgagtaagaaggaagcagtctttttatgttggttttaagtgccacattgtaataacagaaaaaatatgtcttttgttatgataaggaaataaaagaaatggatagtatttatgtaaatttgatataacatctttacttcactgatgagatgaagcatgatatcaggtttatcagcttctaggcaaaatatgatttttaagagacaggaaataaagtttgttttgtaactagaggagttattttggggtagatggaaaaatcaaattattatagttggaattttgccagggcagaaggttaattagcgttcttatagaaatgttcctctactttgcatagtcttcaaggctgtgattttttttctaattagaaaatgtttgagtattttatttaaaatttcctttgtgtataaaattcaaatttatttaataactatttagtgagcacccattacatgccaggcactatactaaggcatagagatacaaagatataagtgactctacctactttctggttgttcacagtctggtacaaaagaattgcaatacattttgataagtgcagtgatagagatatgcactcatttaccattactctatatgcacttaaaaaaacagctgtgaagaaatactcatatggcaccaagaacaatgggacggaagaagtattactaggactaagtcttttgtttttttgaaaaacgtgtttattattactgttattttttgtagagaagaggtcttgctaagttgcccaggctgtgctcaaactcctggcctcaaccagtcctcttgccttggcctcccaaaacgttgggattacaggtgtgatccacggtgcctgcctgtcaggattacgtttgaaggaagtttaactttttataccagtctcactggttttactttttgaacactctgcctgtgtctatgcaaagtgctggcatatagcacatatcaaagtaattaggtggccttacagaactcatattcacagatagatacatttgtatggaagttatgattaataatctttataccagatgataaaggatttagcaacaaaacaaaaccatggactatatgagttgtagaaatcagaaaaagtaaaagtgatgaaagctggtttttgggtttttttttaattaatgaaatttgaagattgctattttggagttatgagtctacttttatctttggctttctctgtaacatacagggcctattttctgtaccattttctgattcttaaacattgtcatttttttctccatttgttttcagtattgtcctgccaggattttatgttctttgagaacagaaactccaagtagtcttgggttcttcacagcacctatgaactgcagtgttaaataactagtatggacagatgctcaatgcaaatttgctaaaacaaacaaaagaagtaggatttttgtgtgtgtatgtcaaaaaggatagtacaaagatatgataatgtagccagtattggtgattttagttctacagagggtggaatttttccctctgtggtaggttaaaacagcttctggtcaacaaatagaatatttctctgaagaaaaagggaaaacatttcatttgattttgaatgagagggaacataatagatttgagcatttgaaggactggatttctgaattttgaatggtaggatggcttcgttttcagttaattattaccacagatctaaatttatgcagacaccacagatagacaggacagaatagtattgttaatttgaattttatagattctgaattgactgtatgtgtaacactttttatattggtctactgatttaaagtacatgttaaagtacatcaatctcacattagcaggtaaatataaaataataaatgtggctaatacagtggatttggggagaagaaaaaattgaataggatgtgtgcatagttctttttccttttcctctttattctttgtccctcatctccttttgctgtagaattaagagggaaggttatcagactgagactgttatgaattggagataagagatttgctgtattctgaagtaatactaataggttttcttgattcttattaatctgttaggattctaggcatatttataaaattgactgtgcatggtgctgtttttttctctccgatgacctccctttctgagcttcctttcatctctagacttgtctacttgtctgaatttcattaattcataagcaatttttttaagtttccttctgtcccagaatacatgcaaggttctgagataagattgtgatgaagatacagcccctgcacctttggagcataaaatccaatgaaagaataaaaacaaatacaaatcagtgtgagtaagggtgatacagtaggagtacacagagggtgcagtgggagtctgtaagaggggcacctaacttcagtatgcatatttaggaaaagcttgtaagaagactgattcttttcttaaggacgtccagctgtctctcatcttctaaagctgcctataacaagaagctctgcccttttaaatttcccttctgtcttccttacccatccaaaactactttccttgtttgctaaaaaacaaaacttagacataaatcataattgatcctcttttttttttgagatggagtctttgttgccaggctggagtgcagtggcgcgatctcggctcactgcatcctctgcctcctgggttcaagcgattctcctgcctcagcctcctgagtagcctgggactacaggcacgcgccaccacgcacagctagtttttgtatttttagtagggacagggtttcaccatgttggccaggatggtctcaatctcttgacttcgtgatccgcccatctcagccttccaaatgcgcccagccagaattgattctcttaaggatcatttgcattaattgataggagtttattaacataaaagtacttacaattgtactagtagcatggatagaggagaaaatccaaggtcaacctccccttaatcataataaaataatatttaacgtgtaggaacccttaatatttgttagacattaagctaactactttatatatttttttattcaagtgagaggtgcaaacatagcaaactccttgactccaaatacccgtttccctcatgttttacaggtgtcctgttctctgcaggcatctgaaaaaaggtctatttaagaagcccaggttgcttagcactgcagtcacccatattagaaacctttaattcattaattttcagcttttgtgaggtgaggtgggagaatggagaagcacgaatatagtatgaaaaaacgtattcagtgttataattgccttgatttctaaagtcacagtatctaatttattttgaaatttcaaataactataagggaggttgtgaaatatttgtttccaaaagcaagcatggattttaaaaggttcctgtaaaatgctgcttagtctaataattttttttttttttttttttgagatggagtctctcactctgtcacccaggctaggctggagtgcagtggtgcagtctcggctcactgcaacctccagctcccagattcaagcagttctcctgcctcagcctcccaagtagctgagattacaggtacctaccaccatgccaggctgattttgttttatcatgttggtcaggctggtctcactcctgacttcattcaggtgatccacctgtctcagcctaccaaagtgctgagattacaggcatgagccaccatgcctggccagaatctctgattctatttattatatgctagaatttataaagaatgctttttttaaacttgatttatatattcatatcctattttataggtgtcctaattacttgaaggaagtaacactgaacagataacaaaggttgaattctaatgtgttatcacctgacctcattacaatttattgttttgtgagagtggtgaatatgttatttagtatttagaagtctctagaatttaggggtaacacatttttaaatgttgaaaatcaactttattgaggtaaaatttacataaaataagatgcactaattgtaagtgtatggttagaaaattttgacaaatgactatgcatactcatgtaaacattatcttaagaaacagaacatttccatcactgcagaaagttccttcatttcattttgcagtcattcccactcctcttccgtgcttctcccctaggcagttgctattctgctttttgttgttttagtttagtttttccttttctatgttggagtcatgtagtgtttactttcttacatactggtttcttttgcttaccatgatgtttttatgtttcatccatgtttgttgtatgagtagtccttttcttccttcctaatacattgtatggacatacgacagtttgtttatccattcatccgttgatagacatttgagtttctagttttgggctcttatgaataaaactgctgtgaacatttgtgtatgtctttctgtggacacaaattgttctttctcttcagagtaaaattaatggatcatatgcaaatatatgcttacctttataagaaatttccaaacagttttccagaatgttagcacattcccaccagcaatgttataatgttctaagagttctagttgctccacctctttgctaccactgtttatgattagccagactagttggtgtatagtggtatctcattgtggttttaatttgtattttcctgacgactgcagctgttaagcacctttacatgtgcttattggccattggtctatctttgtaatgtgtttatttaagtattttgccccctttaacatttgtcttccattattggctggagagttgcatataatctggatacaaattctttatcagatatccatattgtgaatattttctctgtggtttgccttttcattttctttttctttttctttctttttttttgtgacagagtctcgctctgtcgcccaggctggacccgcctcccaggttggacccgcctcccaggttcacgccattcttctgcctcagcctcccgagtagctgggactacaggcacccgccaccacgttcggctaatttttttgtatttttagtagagacagggtttcactgtgttagccaggatggtctcgatctcctgacctcatgatccgcccttctcggcctcccaaagtgctgcgattacaggcccggcctgccttttcattttcttaccagtgtctttagaatagcaaatgttttaaatttttgtccagtttcctaggttttttttcttttatggtttataaacccaccctaaggtctttttttaatgttataaaatattttgttacatgtattttatctgttttctttttctttctttcttccttttttgtttttttaataccctaaggtcttgacgatttccttttgtgttatcttatgaaaaattttagcttatgtttaggcccatgatctgctttaatttttgtgtaggtcatgagttcaagggttaaggttcatgttaagctacagtaggctcatgtactcatgatgtgtcattatcagcaaaaatagatatgtatatacactgtgtgtatatatatataatttgttatatgtatatgttttctatgagccattgtacacacagtctatatatattttttattaacatatctttagcatatcgtttggttggtaaatcagacttatatttaaaagattgtggctttttgtataaaaatctttagaaaaagtttttattttctattcattatctttgtgttgttttacctgttttatatattgacttcggtgaaatgcttagatcctgcaaagctgaaaatatatgttgtctctggctaacacagagttcaagatcttcagatctggtctatgataaaacagccctgggtactaatcagggttctaccctggcaggacatttctattcctctggctggggccctctttctctcaccttgccctgacagttttcatttgctgtttagaagaaacacaaattctcccttaggaatcaggtaagtatatgaaagagatgaaggaactggttgagctcacagattctttatcttttctatttttttctcttttctgtttctgttttctataagccagggtttttcttccccctgaactcttcctttctcttcccttctttggggaataacttcaggtactctgtaagcacctcctttctttttactgttttcctgagtatattttcttgagagtgagactggatttctgcagaattttccttgagatgctcctagccccatgtcctaagatggttgatttttcttgggttaaacaccaattagggtaccaaaaactcagggcagtggggcagggggagaatttttttactacagagaaatagcatggatgtgaatgggctttccttctagctgtctcatgtctaatacttaatattttgcagtttgccatagctgtttttaatattggagcaattctattatactccgccagtgagaaaacagtatgtgtgactctgtggtgttcttgtgtttgctttgttgatggtggttagtgttcttattttaccatgtggatttacatgtgctactttttgtttctccagatggaacacagtttattactaatatataattattgtcttttcctttctctgttttctcttccttcttgttttacactgtggttcttgtgcaggtcttgttcagcgttgcgtaatcatccagaaagatgacaatggatttgggctgacggtcagtggagacaatccagtcttcgtacagtctgtcaaagaaggcaaggcattttaaaaaacaatttatcactcagtaaacagagtaagaatagaaaagcttaaataatggcaattgccaagaatagaataattacatagattgcaggtcatgtggactattgtgctagattcgtctatcatgtcatagttacaggaaggagtttactccagttgatttttttttgtacttgttagaaagaaatcagtttttatttagttttagaaatcatgtgactccttggtcatgatactttattgtccacacaaaagtttctgaaatttcagttttccatggcaccactgatattttggcaaagacagattaaagagatagctatggcttcagaaataccatttattttcccaaaacaacagtgataatattttctactgctgttaccatatattgaatacttcctttatgttgggtgctataattttgaggtagacaatttttttatccccattttataggtgatattgaggcttagagtaaagaaacatcaaatcagtccaaggtcacacaactagtgagtggcagaagcagcatttgaatgtaaagtctgactttacagccttgttttttttttttgtttttttttttttggagatggagtctccctctgtcaccagactggagtgcagtggcacaatctaggctcactgcaacctctgcctcctgggttaaagcgactctcctgcctcagcctgccgagcagctgggactacaggcacgtgccaccacacccagtgaatttttgtatttttagtagagacggggttttaccatgttggccaggatggtctcgatctcttgacctcgtgatccgcccgcctcggcctcccaaaggacagcccatgtttttaaccagtttgttatactgtctctctgtcaggaagatgatcagtaaatgcaaatgaatcacattttaagcaattaatttctcatacagatggagcagccatgcgggctggagtacagacaggtgatcgaatcatcaaggtaaggaataggctattatagaatttacggtaggattaaaaaacaacatatattggtcatattctgatttttttcacttggatttttataaaaagcatcatacttctatgtatgatagatctgttgactatacaaacttatttcatttgttttaaaattaatactaccctttactgaaggacgtaataaaaggattgaaaataatggaggaatatatgttcttgagtaggagagtaattcagggttggaaagatcatttctgtctagattagtctgttattaagcaattctcatcaaagtacaagttgaacatttctaatctgacacctgaaatgctcccaactctgcaagtttttgagtaccaacatgacaccatgaatggaaaatttcacacctgacctcatgtgatgggtcacagtcaaaagttggtttcaccaggtacagtagcttgagcctgtattaccagctactcaggaggctgaggtgggaggattgcttgagtgcaggagctgagactgcagtgcactttgatcatacctgagaatagccacagcacttcaacctgggcaatatagtgagaccctgtctttacaaaacaaataaaaccaaaccaaaacaaaaaacttggttccatgcacaaaagtatttaaaatgtataaaactaccttcaggctatgtgtataaggtatatatgaaacataaaaggctcatatttaaacctgggtctgatccccaagatgtatcattatgtatatacaaatattccaaacttcaaaaaaatccaaaacacttcttctggtaccaggtatttcagataagcgatacctgacctgtatgcaaatagaattgtagtggtagatgtctatctgattattcttccagatgaactttataaagatataagaatcactaaagataaaaacatgttatatgtatgtgtatgtatgagaagagatgtatatgactctaatctagatatagacctaccagtggaacacaacagagagactagaaatagattttgaattcagatcagtagagaaagaatgggttagttagtaactattctttaaataattgactaatttgattacttaaaatcaaattattacataagaaaacataccatgaaaaataatttggaagaaatatctgaaacgtatcacagaccagatatccttaaatttaaagaacacttttaaattataagaaaggaataaatattctaaaagaaaaatgggcaaagaattttatcaggcagttccctaaagtaactgaaatacataacatattaatgaggatatggccaacctcactgataacaaagaagaagaaattaaaatgataggtgaaaaatacatttggctgtcagaaaatttaaagattggtaatacacatttagtatagtttgggtatggtaaaatgactattctcatgagttcgttgtgagtataaattaggtaaaacctgtttggatgaaagtctgtgaatatgtatcaaaagcctttaagaaagtatataacatgtgacaagcaattttgcttttaggaacttatctgaggaaataagtgtacaaatgtgaagtcgtgtgtacagggaaatttgtactggctttattacataactgtgcataaactgagggacagagaaataaattatattccatttgcagcttttgaaaagaatggattaggtcagtgtgtatctttattgaaagatagctgccgtacagtgaaaaaaaagttttattttttttttccaggaaaaagccagtcgtaatgtataatgtttatgtgtctctttggtgtgtgtatactagaaaagtgtctccaaaattaaatgtcatagctaacagtaactgcctcatggggcaggatgagtatacttgtacttctgttttttacactgatatatttgtattttagataacttggatcagagaattaatcagaaaattaatgttaaatccacatttgatagttttgccttgatttgtttggtttaattcagaatcgggataacattttctacatttagccggtctgaaaattaattttctttgtgaagattagatcatggttgaaaaactaaaagcaaattgaatattgtggaaatacttattttaaaaattattttttattattaattttgacaaattgatgacttggtaattaaaagcaaagagatcttttctatttgtatgagcccttcaccgtgaacgatttgtaaatctgtttcatgttatgttttgtcatttgtcatggtgaataagttgtactgttttgtatgtcaaggcctcggtttatgtttaagttcattttgttgctgaatatgccctgtagaatcatggtgtgaaaatgaatattgaatcaaatacataaatattttaatgtaatgtgattactatattatattggttatattatgtatgataattcttgaagtcattttatccattgtctcaatagaatgtatctgacatacactactttcgttttcttacaggtgaatggaactctggtgactcattcaaatcatctggaggtggtgaagctaatcaaatgtaggtgaatgttattcttagttttaattgttttctgaaacccttaaagtaaggagcagcaaatttcctgtaataggccaaatagtaaatatttaggctatgtggactatatagtctactgccgactctgtcattgtatcatgaaagcagccatagactatatgtaaatgaatgggtgtggctgagcttcagtaaaactttatttgccaaaagtctgtgatcctggtttagccccttggctggagtttgctgatccctgcattgaaggaaaatctgaggtgaaaactcttagcttactaatagctatcttttgtcaactccatttatatggttgattataatattcctgtcattcttggtaatatttgatacatatatttgaaagaaatgcatgagtcacctgagaggaaggaggttgagaagtcagacatatggcctgatgaactgaaatggaactttaaaaatcatctagcacaatcactttccctcagataagtaaatgattatataatccagagtagcgatcttctcttggaaatctttagggttaagaatttgtgatcttcaggtttgagtgaatagcccacttggacttagttctctgtggagaaacaggcttgaagcagtgggagtctgcagctaacctcccgtcacttgcagggtcaaaggtggattcacgaacctcgagctggcagtgagttatgggcaagccaggcctcagccactcacagggcctcagttttcccatctgcacagggagaagggaaggttcagtggccctgtgagctttgctagcaggtggtgatggggtgggtcatctgaatctgagtcaggtggaatcttccccaacctgggctttggtttcattttgttgttatcctttaaccttacctgctttccaagagagattttatgttttcttggttttttttttttttttgtttgtttgtttttagggtagggtcttgtagaatgcaatggtgcaattatagctcactacagcctccaacttctgggttcaagtgatcctcccaccttgttttttgttttttgttttgtcttgtttttttggtagagacagggttttgctgtgttccccaggctgctgtcaaactcctgggctcacccatctcagcctcctaaagcgctgggattacaggcacgagccactatacctggccaagattttatattttctaattgcttcacatactgaatggaaaatagcatgacagttataacagaagtaaagaaagtcacatgagagtccaccacctaaaatataacttcctttttctttgttctggcctggtttgggccgtatgtatttgttattgtatctcttaaaaaaaaaaaaaaaaagagagagactgcttgaactgaatgaaatttttttaaaaaaggaattaaaaaaagaatttatgatcttctgcatcagattattccacagtaaagtagactagaaataagagatagttgtttgtgatcaatcagaatcactactgttttatttaattctgtttctctgtattgggtggatggacatcttcaaaagaaatttaataaactaacttttttcttggcctttttactgctatgttaagcaactatgaaattttttaaactttttcatcagagtaccagtgctccaaatggtcactttgatcagcgttctttagtttaaaagagtgcagtgatcaaaattagatccccatacttgaataaacttgaccacttatttaatgagaatgtgatttataaattgttatgtgctgcataaatatggtttatgttaatgagtttatgcctgatgtccattgaggtgtataaaaacatttctttagctttctaggttatattttttgctcattccagtataaattttacttaaaaaattaaatcctgggattctagcaataaattacttacccaatagtaagggcatagctaaaaacttaaagtaaagcataaaaacctctgcatatccaaaactgatgtaaatttgacatcacatctgtaaagcctgggtgtatgtaacagagttcctgcatgtcctactttctaatgtgtattctggatataataaaagtgatatcaaatcagagcagtttagaaacagctaaagaaaggaagggaaaagctaggaagctattaaaaccaaatacataggcaagtgagatataatagatgactttctgatagagagcaataagattgaagagccttagaaagtgtttatatgtaaaattcctccaaattataacacttgtgagtattatacatagcaaaactagtttttagaacaccaaaacactgtgaaataattgataatgatttccatgggagggttaaattgggagacaagtgtgaaatacatttaaaagttctattgaaatatctaagaaaaaagttttgccatatctattactgactctgattatggtgtttttttttgtttttgtttttgtttttgttttttgagacgaattcttgttctgtcacccaggctggcgtgcagtggcgcaatctcggctcactgcaacctccgcctcccaggttcaagtgattctcctgcctcagcttccctagtagctgagactacaggcatgtgccaccacgcccggctaattttttgtatttttagtagagactgggtttcaccatgttagcaaggctggtcttgatctcctgaacttgtgatctgcctgcctcagcctcccaaagtgctgagattacaggcatgagccaccatgcctggcctgattatggtgatttttgctgtctagattcccgccccccgcaatatgtctactgaattcctgtccattcctccaaatattttctactaaaatttactacttattattgattgtgtttttccctgttattgtggaatattttttggtcatactcattttgtaaagttaatttaaaattgcattttatgttctagcatattcactaaaccctgcctagttagtgtcatcttaaaatatgaagatctaggccaggtgctgtgtctcacacctctaatcctagcaccttgggaggccaaggcgggtggatcgcttgagctcaggagtttaagaccagcctgggcaacatggcgaaaccctatctttaaaaaaaaaaaacattgcagctacttgtgggggctgaggagggaggattgcttgaacccaggaagtcgaggctgcagtgagctgagatcgtgccgcggcactccagcctgggtgacaaagtgagaccctaattaaaaaaaaaaaagaagatttaaaaaatttacatttaagaaattaattaaacatagccactaatagatggttgattttaacactcctctaaataaagaaaatatataatatattcttggagttataaattttatttgcttttaagtaatatctgatcttactagtagtaacttgctatctgaaaacggcatcattcttttggatttttagggcagtcataaaagagaaatgacaaattagtttttttttctgtggagacatgatgtagcagatgatgggactgtcttacataactggatcttttagaactatcgaagattaagtagtaaaatggtataaaaagtttcttgacaatgttattttcccttcccttccctttttccgtctccccaccccaagctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggtaagaatggggaaatttcttagttaaatgctcagtcttataaggatgtgtttactttatatggagagttttcaagtattcggctgatgaactaattaaatttaagattttagaaaatgatttactaatataaaaattacataataggaatgattagaatattgtcatagcagatttaatttaacaagtattagacacctgccatatgtaaaacagtgtgccacccacagaaatatagttaaggtactctatgttcaagattatagtcatcttagaatgtgtacttttaggagggcggggatttttgtttattttgtttactgttacgtttccagtacctgaaatattgcttagcatgtagaaggtgcttaacaaagctttgttgattgagattaagtcaagagtatacaagtaactataatacaaggcagaatgtagacattatgagggcaaaaaaaatgctaagttctatgaggattcaaaggagggagaaagcacatagaagaagaacaataaatagaaggagccaaaaaagcatcaaatattgtggagaagtagctaggatttttggttggttggtgcctgttaaggatgtgcatagtgggagatgaacttgaaaatagtaggttgactatatattttgaaaagtcacatctcccaagctaatttacatgtaactagataagcagtaagaatccattcaatgttgtttctttttaagcaaaagagtacatgattatcctaggattataggaagactaatttggtaaaatattatagggttgtgaaacaaggagggatgatgggtgatgaattagggagctgtcttcatatttcaggtaagaggtactgggagtttgagctatgcatggggatcgatagtaaagatccaaatgagggaaagtaaaagatactattcttatactaagacaacttcatttctccaatatcaatatttagtgttctcttgaatccagtttagtaaaaatgaaatagaagggcagacatttccttgtagtttcttgtaagtgtcatgtctgaaagcctgtccacataacccggaagtaaaaacctaataggtattgataattggagccgaggcagaactttgtatgccacattttctctatttattttagcttcattttgtctatactggttgttgtttgttttttatctttttcttttctaggaggaaaacaatgtggttcataaccagaaagtagaaattctgagaaaaatgttacagaaagaacaggaacggctacaggtattaaatgagaagtagggctgtttacaggccaataaaaatgtgagtgggcatggttgagttggtgtttatcagtcacaatcaagcagcattgtaaccaatgccattagttatattattgattaagaatggactatttctgtatcttttttacataagtaattaattctgaaaatatttttataacttttcagttattgcaggaagattacaaccgaacacctgcccaaagattgctaaaagagatccaagaggccaagaaacacattcctcagctgcaagagcagttatccaaagccacaggctctgctcaggtagcatcactattacaagtgctacccaactttttgcaggagaattttcttctgggaatgtgtcagagaatgttgcagttgccttttttaaagttatttttctagcgtaggacaacaggatgtcctgttaaggatgttacagaagtaatgattaacaaaaataaatgtgggcgtctgattgtttgcttgctcatgagatcacatttctttgttccataataatttaaaaaagaattgagtgcttttgctttgatgtgacaaactactaaaatgtatttagatatatatatatatttatattttttgtggttcattctgccatcttaaaacagaatggcagttgatatgtttttaaataggaatttaagaatttacaacaacaggcattgagctaaatatatggacaagcattttcttatttaatctgcataacatctctgaggttacttatggttgttttcctccagtttacatatatacttagagagagttagagagattaaatgacttgtctgaggtcatatagctgcaaagtaatagaactggaattcaaacccagtctgaggatttaaaagcacattcatactcttaatgactatatttttattgtaatttaaaaatagatttcagtagaatttgctgtatagttataagctatagagataatggtctcataagaaaaaaaaagctcagcatttatatgttaaccagacttacattctgtaatattcagatttgggatatgtaaagcaccttgtacttcatcttaaagcaaagtagataaattgcctatacatttaaaataggtaaaagctgtttttttgtcactgttcccgagttaaatctgaagggaaggctgcatattcgcaaaagaattctttgagatcatctagcctaatctgcttactttctgatttaaaaaaattatgttataattgagaaacctagggtctaaactggttaaatcacctatacaaggccatacagtatgtaaggtcccctgacatcctggtttagtgtacttttcattccattgtttttttcattaccttcagtcccagtagcgatgtcacattttgagtgttacacctcagtaatgttgacagttttatgttattactaggcaaatataatattcttaccctgtttggacagcaatctaaatgcttataacctggccaggcgcagtggctcacacctgtaatcccagcactttgggaggccgaggcgggcagatcatctgaggtcgggagtttgagaccatcctggccaacatggtgaaactccgactctactaaaaataaaaaaattagacaagcttggtggtgcatgcctgtaatcccagctactcgggaggctgaggcaggagaatggcttgaaccatggaggcggaggttacagtgagccgagatcctgccactacactccagcctgggtgacagagcaagactccatctcaaattaaataaataaataaatgcttataacctgatctaaatgcttataataatttatgttatagtattatgtcctagaattggccattgattgacactctgaagcattggaaggtagttaacaagaaactatagggtaataacctttattaatgggcagacaatataaattatataaatataaattacataaattaacaaaccattttatctttttgctatatttagaagtttgaacttacattctttttaccaaaatatcacttgccctgtctttaaggtcatgacattttagaataccggaattagtagttatttatggattttactcgtagaattttaaacatacttgagcatatcagaatgtccaacttttagtagtctccatgtagattgtagtaccactatttctttatgcagcaagtaatgaaagttttcttttatgtgtttgtgtgcgcgtgtttttctttcatctgttttaggatggagctgtagttacaccctccagacctttaggggacaccctaacagtcagtgaggcagaaacagatcctggagatgtactgggcaggactgactgtagcagtggagatgcttctcggcccagtagtgacaatgcagatgtaagctttcagttttctaaatcttttttcttctgtattcttctttacagcccctttctagatttgattttaagtgatgtgaattagaggtgtcttagcactttttaccatccccatttttaatgtaccaatttgataaacagaaatctggttactgttatatataagcttttaattccagagttcactttttcccttgaacacccattgccaactgtttcttttacagggatggaatttcccagcaggcatcttgttcgtgggtagagaagttactaatgccagtgcatttttactgaaccgagagaccaactgttgatatctttaagagcatgttaatattccatttgtggtcagagtgactcagtcttgaatcatggggcactttgccattaccaagaggaaaaacctcagtcctgttagataggcttcagttaatagcccaggtttagtgacagcactttcttgattaacccagaaactgccagatgaacatgactatctgttaagatgataataaaacattttaagctgaatatgatgtaacaccatagacatatgaatacctaaaagctaagttcagtattacttacccagcaatactttgtaaattgtatgcagtggtaggaataatgacttaaatgtagatcaccctctttaaaagtgatgagggaagaagtctgaacgaatgttttgtaattgtgggtcatgaaatcaattttgtgggttgtatttcttttttaaaaaaagaataggaaatacagtgctttgcatatagaagaggtgtcacttcttgggacttttgttacatatacacacatctactatttaacaatgtgaagtttctctcttattgaaggttgttgttgggggattgttttgttttgttgttttttaaaaaggaagccgtggtctaagccatcattcaggctatctcttgaggcttaggcccaatgacccagttcctcatgcaaaaaacaaactgaggatttgtgggttttttgttttgttttgttttgttttttaaggtagtgataggagtcttgtgattgggttagctaaaggttttaatggaaaatttcaatttgggctcaaggaaaaaatggtagtcactaatatttgttgggtatatgtcccatacacggtgataaggttttatgttccttagttaattctcaaaacagccttatgaagtagtactgttgttactgtaactttacaaaagaaaaaattgaggccaaagggagttaactaactttccaaacttattcaggcaataggtgatctacttccacctagctccaaaataccagtaatcgaaatataaacaaaagcactgaggtttgaaaatgcgtaacattttgagagagcagtgagaattttagggcaacctggcatattagggttatagatggaatggctagagattatcttagaagccaaatcatgaatccaggttataaagggcttcaacttgttctagcagtacataccgcttttgggaatgcttttcgtactcttctttttgttttagtaatgcgtctcctcgctgttttcatggcttgtccctaccatgagatgggaagttccttgagagcagagggactgtcttgtctgactttatgtttccaaagtgtagcaaattgtaggcattcagagcaaatgatacgaatgagaaatttgaattttatcttgtatttagaggaatgttacaataaaacatgtgacttagaaatataaccttataaaagagtgaattgttggctgggcgccgtggatcacgcctgtaatcccagcactttgggaggccaaggcaggccagtcacaaggtcaggagttcaaaaccagcctggccaacatagtgaaaccccgtctctactaaaaatacaaaaaaaaattaactgggtgtggtggcacacgcctgtaatctcagctactgcagagtctgaggcaggagaactgcttgaaccagggaggcggaggttgcagtgagccaagatcgcgccattgcactccagcatgggtgacagagcaagactccatctcaggggtgggtaaaaaaaaaagagtgaattgtttagtatagaaataggcattccaatcaattaagactgtttgacatgtaattgatacttagtatttgaatacatgaaatcaatgaataaagtgggctttatcttgcatgcagaagagagacaccatcagaaacatatctgtggaaaatgatttggtgtaaagagggagatctgtaagaaaagaagactgcttggcttaataggaactttaacaaatgtgtgctgaatggataatagttagcatttattcagtacctactttgtgccagaggttgtacccaatgctttacagatactcttttttaacactcataataatcttaaaaaagcagtatcaccatttcatagatgaggaaactgaggccaaataaataaatgaatattgtggaaatccgagtgagaaatgataaagtccaagctaggctatcttctgaacacagaacacacaggtttaatttctacaagtgtctgaggctaaagatgtgttgcttttagcttatggatttccatgtttgtttcaattttaagtatggaggacccggtctgcttttgttgttgttttaacagtactttgagtcgcggttttacattttatcttttgaatcagtgcttttaacttttttcattgtcttctcatttttataaaataatttcctggtggtgtttgtgaaagttccctgcttttgcttaccttggagaaggctttaaagaatgccctgatacccagttctcacaagagaagcaacttggtaacaaatcatcatctgaaattcagagcatctatcattttgattttcagtttgtgagtgatatttttgaaaaattatttattttggaaaattgttaaacatattcaaaagtaaagactaacataatcctcctcatgtccctgagaacctagtctcagcagttttgtttgtaccccctattcctcacatcctccaaacaccagattaaagtaaatccaaggcattcgtttattaatatgtctctctctaagagataagaagtttttaaaatatagctataatattcttattaaatcctaagaattaatattttctcaatacacaattttattaccttgttttataatgatctttttacagtttatttgattcaggatccagtcaaggctttcatattgccattggttaataagtcattttaagtctttataatttataatagtttccttcttttttttccttggccatttgttgttgtggttgttgttaaagaaattgagtcagatgttcagtaaaacaatccattttctaattatattttcatggtgtcgtatgacatgttcctttatctaaattttcttaaaactcctagttaaatctacaagtcttgatcacattaggtttgatagttgttatttggaataattcatagatgatactatgtacatctcattatatcacatgaggatgtgaatggctgtcttactgtggttgtaagcttaaggtgtttaggtgatatcaacatgatttccttcattataacgtcccctgtcaagcttttttttttttttttttttgagatggagtctcgctctgttgcccaggctggagtgcagtgacgcaatctcagctcactgcaacctccgcctcccgggttcgtgccattctcctgcctcagccttccgagtagctgggactacaggtgtctgctaccatgcccggctaattttttttgtatttttaatagagacagggtttcaccgtgttagccaggatggtctcgatctcctgacctcgtgatccacccgcctcagcctcccaaagtgctgggattacaggtgtgatccaccactcccggcccccaagcttttgtgaaatgttttcacatgccatttatgatcaaaatgcctagatccattgtttaattcagagtttcaaaaggatattattataattttgtcagtatttctgtatttattacatggagttatgttacaaaaaatgatttcccttactagctaataggttaccctaaaatacagcttatacagaaaatgtagggtaaatacttctcttgattcttttcagaagagttttttcaggagagatgatactcttacaaactccaaaggtgacaagtgggaagggtatatgtgtgtaatattttgaactcatagatttcagtatgagttactcttttcttttgttggtgggagccccctcaaattttctcctgtgttcttttgacatgcccctccaatatctttgatagctttcttgctttttgtgacagaattattctaatcttttatatatcttgtccaagacctgaaagtcattcatttctccaaggtggggcatacatttgaaagtgctgttttctcttggtaacagaaatatctgtgataccaccaagatatcttgctatatgcataggtaaaatgtatcttccctattggcactcgttaggtctctggttcctcattttcattgctctaaagaatgtctcccgttgctttggggtgttcctcatctccacaaagtgagtttctgtgtctcatatagttcatattttatacagaagttctcagtatttgtggacagcatctgtggattcagccaaccatttatcaaaatattcagggatagaaatgcatctgtactgaatatgcacagacttttttcctagtcattatcccctagacaatacagtataacaactatttatacagcatttatgctgtattaggtattataagtaatctagagatgatttaaaatatatagaagatttgcgtatgcaaatactataccattttatatcagggacttgagcatccattcccccacaaacactgaagaacaactgtattaggtattatacaataccatataaatgtattaaaatccacctttcacatgaagcgagtaacagaatagtagaagcttaattgtactcataagtagggcaaaatgcttttagcttggatagaaaggatagtttgagaaggtaaggattaaggaagataagagagtttgattttgacataatgagtttgaggtatgcagtatatctaattatttggtagaaaagtaacctccaggcctggagattaggtaaaattgttttgttgattctgtattgtttatcaatataaaattgaaaaggtgagagaataagtgacttgccaaagtaaggaaaaagtagcagaaccaagcattttacgaaagatatttagtagttgtaaatacaaatatgaaattcagaacaatttttttttcacacttttttccctcatctccttttggtgtgcctattgaaatgaactgaagatcttgtttttttcattagagtcccaagagtggcccaaaagagagaatttatctagaggaaaacccagagaaaagtgaaacaattcaggacactgtgagtatgaaatccatgcaatgatagtgctgtctttggctttccttatacttaaagtatggtatagacacatctgatgtttacatattttattttttattttttggaaaaaaaattaaaatttattaaagaaacttaataaagatttgaataagtcaagagatattccatggtttgtaagtattcttaggttccttcatatttgtcgtggtggtaacataaaatgtactagtttaaccatttttaagtgtatagtggcattaagtatattcacattgttgtgcgaccatcactgccaaccatcttctccaactgcaatttggtacccggtaaacactaagtctacatttcccccttccccctagcccctggcagccaccattctactttctgtctctatgaatttgactactttagatactcatgtaaaaagaatgatacaatgtttatccgttcatgactggcttctctcacttagcatatgtcttcagctttcatccgtgttgtagcatgtgtcagaatttccgtcctttttgagaccaaataatattccatgacatgtatatacaccacattttgtttatctgtccgtttgtcagtgggtacttagattgcttccactttttgctattgtgaatatgctgccttgccttcagtttttgtgggtgttcatcaagaagaagaattgtttgatcttacgtattcttaattgcatgcttttaagcactctgattttatcttctaattacatttatttacagttttgtagtaaaagatacaacagcattttgtcatctttttattgttagcaacataaggactattgaaaaatcagagacatcaaatcagttataaaatcaaaattgtctgactactgctcgaaactaatttatgttgtttcacctaatttcttttttttaattttttaatttttcctttttttaaagagggagtttcgccatgttggccaggctgttctcaaactcctgacctcaggtgatccacccgcctcagcctcccaaagtgctgggattataggcatgagccacagtgcccggccagtttcacctgatttttttttggaatattaaagccttgaggttaaagaaaataataagagttgttaaaaggcagaattgtgtttaggagactcaatatgtagtgttgcaacactaggaggaaaaactacaggtacatattattcactcagtttaaaacttgcggatctgtttatacaacttcagctatagccactataactgctgtgcaaatgactctcaaatcataggcctacccttctttgctgaactccatccagatcttgcaatgttaaactgctgttagatttaagccaaactcatttttttcctatttcttccaaaatttttattccccaatcctatatggtctttaattttagtacttatggtcttcagacatcctgtatgtatgtatgtatttatgtatgcatgtatttatgtatgtatatatgtatgaatgagacagagtcttactctgttgcccaagctgcagtacagaggttaactgtaacctcaaactcctgggctcaaactgtgtacccactttggcctcccaagtagctaagactatagacacacgccaccacgcctggctaatttattttggtttttttagagatgggtcttgttgtttttcccaggctggtttcaaactcctggcctcaagtgatcctccctccttgacctcccaaagtgctgcgattacaggcctgagctaccgtgcccagcacccatgtttattattttatatattaatgcctctgtactgccgtttttgtgctgaatctaactttgtgagttgacaaatggaggagctattgcatgggaaactatctgacaatctacaatttattcttagaattttgttatctttgtttctatagcagtgtttgtgagattacttgatgattttagagcattgtatcagtgatttttcaatcaagagtgattatgcctccgtggacatttgacaaatgtctggaaacgctgcagctggcatctggtgggtgcatagaggtcaggggtgctgctaagtgtcttagaatgcacgggctagaccctacagccaagaactctctggcgcaaaatgtcaacagtgccgcagttgagaaaccctgcattatacatttatgaaaattaattaaaaatgaaaacatagagttcgatgatagccttcaattatgtatcattaatggaaatcttgggttagtacttctcaggtatattagcctctctgctaactttgtcttaccatttctgctcttatttttcctttctcctattgtcttcattcactttttctttaattttttaattgtaaccatttatgtaagccaactttatttttttctgtaagaagttttaagtatgtatgaattaataaaagaatgtacagaagtgtacagaaagtgttaaagtcagataaccaagtgtatagtgagcaaaggatatttactgtttccaaggggagtggttttttccccccaaaaaaaactcgttgttgtggtctttttctctgccagagtggtacatggccttgaaaatttgtgaacccctactttgaaaataaagtacttcaaaggaaataaacaaaaagaaatctcaccatttaagtgaaccatgtctttttgatgggttggctttattctttttctaaatttgaccaccaggtaatttttctgtttcttttccctgaatgttgccaggacactcaatcacttgtcggaagtccctcaacccgtatagcacctcatattattggagcagaagatgatgattttggtactgaacatgaacaggtgatgacttttttctttctaaaaaatagattgttactttctgcaatatctgatttgttgcaaaaatgagcacgttctggagattaagataacatttgtaaggatttgaagctaaatcttagaaccaatagctccttgggttaattgcttattttagctttgaccaacagaaatgaccttgcttttaaagccagtgagagatcattaatatatgtttaagtacttcattttattggggttgagtgtgtttcttaaaatagtatttttaaaaaaaatttcaaatcccagttcattggtgctataaaggaatatgattagctagattcttgtccttgtatcctgtgatcttgctaaattcacttattatttcttggtgcttttaaaaataagtcttttggagttttctacatagataaatatgttgtctatagtttttatttccttattttcaagctgtttatcttttatttcttgttcttgcctttattgcactggctaggacttccactatgaggttgaatcagagtgacaagacatgcttgccttattcctgctattagggagaaaacactcagtctttcatcattaagtatgatgttagctataagtattttttagaggctctttataaggttaagggttattaggttaaggaatactcctggtttgctgagagtttttatcatcactggatgttgaattttgtggaatgagattattatgtggtttttctgattgtctattaatatggtaagttatgttgattgatattagaatattaaactagtctcgcattcctggaatgaacctcagttggtcatgatatgttatcccttttatatattgtcggtttcaatttgccatattttactgaggattttttacatctttgttgatgaaggatattggtgtgttgtttttctttttgtaatacctttgtctggtttgatagttgggggtaatgctggtctttagaatgatttgggaatatgaaaattgtgatgctagtttacattattattgttttctgtgttcagtatatttagggattatacaaatattctaggatttgtcttacttaaaatcatacaacttcatttcccaccatttctgcaattagcccagaagaaaaggataaacagctattttatgattgggcaaaaagccttccactgcatttctagaaatgttagactgttttttacatactgatttgtatacatccgagctacttgataatcgtctcctaaatttccgttctcccacagtggtctttcttctaacctatccccaagaggtggttaatgttcacagaaagagattccatagcttctgttgctaataaattttagtgaagttttttaaatcttgaattttttatagggagatcaaagtgaaatttggatagctatgttcaattgagcctactttgcatttagtatttgtatgttggagttactgatgcataatcatttcttcctctagatcaatggacagtgcagctgtttccagagcattgaattactaaaatctcgcccggctcatttggctgttttcttacaccatgtagtttcacaatttgaccctgcgactttggtaatatattttacaatctagcagattcagagttcttctgttgattcatgtgccatagaacttttcctagctatacaacgagtgggcagacttctttcagttttccgtataaagacagatacaaaagataattaaaacattatttttaaagacttggttatatagtaataactacattgtttatggtgacctacctgttccagacattcctactcaatggtgacctagcaaattacatttttcatggttcctcattttgtctttttcattcctttctccactacagctctgttatctctattcagacctgtataaacataccaattccaaagaaactcgtcgcatcttccttgagtttcatcagttctttctagatcgatcagcagtaagttgccaagttaatgttgtaatctttgccttagtacatggaattattgtcctcctgcttcctatcttccctcccatgtttttggattttactgtgctttctcacacctgtattatatttcaattattgattactctagacttttttttttttatcatttctaaagtagtttaggcatatgaattctcacagtaggttttaggggattatatatatatatatacacacacacacacacacacacacacacatatatatacacacacacacacacacatatttgtgttttttgcatgtgcataattagagtgaggaaatgaaaaagggaatacatatatattaagacccaaggaataatacttgaataactgaactctgggtggcctctttgaagtttggaggcataattttaactaaaaagtggcagaaaagatttcacttacactgaaataaatgatgataacgttatattttgtcattaaaagtgttaataaggtttttaaagtagtaagttttattattagtcttgttatgggtaaatagcacctagcccttaatgcatactggataatcatgccgcaggtccctagtcctttcacatttgcagttcccttagacgactgcctcatgctttttccctcctaaaacctccatcacttcctttcctagtcctttctcagctgataaccttgaccttattgtttctctgagaaatttaaagtatatagaagagaacttctaccagatgtatcatctgccctcattataccataccatgtactctactctttctcctgatgctatggagtgactgtcttttttttttttttttttgagacagagtcttgctctgttgcccaggctggagcacagtggcacgattgcacctcactggaagctctgcctcctgggctcaagtgatcctcctgcctcagcctcccaagtagctgggactacaggtgtacaccatcatgcctggctaatttttgtattttgtagagccggggtttcgccatgttgcccaggctggtcttgaactcctaggctcaagcaatctgcctgcttcatcctctcaaagtgctgcgattacaggcatgagccaccgcacctggccttgattgtccatcttttatccaaggccagctctgctccagtttacagtgtatttccttatacctactcaaagatcttactctaacaattatcctcccttctcctgcatcatcggttttatattttctacagataatcattcacattagtctgcaaatgttgttattttccctttctaaaaacaaacacacattttggctctacttctccctccaactcctgccccgttttctttgtatgcctttacaaaattgtctgtacactttcacattcaattacctactcagtgactttcctaaccaacctacttaaaatctcaaccctttcactttgtcactttttctattatttttgtccatagaacttttatttagttagttagtttgtttacacagtcagtcttctgtgcctgcagcttccacgaattcaactaaccatggttgaaaatattcaaggaaaaaaacaaaagccaataccacaataaaaaatgaaacaattttttaaaaatatagtataacaactatttgcatagcgtttacattgtattaggtattataattaatctagagatttaaagtatacagcaagatgtgcataggttatatgcaaatacagtgccattttgtacaacggacttgagagttcgctgattttagtatccatgggggttcctagaaccggtaccccatgtggatatcaagggatgactatattcctactctcctaccctgaatataagttttattaggccagatatttttattctgtttgttcactgctgtgtccctaacactgaacagttcctgggacatagcggggtcacttaagtatgtgttaagtgaattagtgttctgatcctactcccattgtttaaaatattgtgttatttttattaaaataatttactttcctaaaaaaatgacaatatattgaagcatgtttgaattttgcatttcttaagagggcaccaagctaagtcaaaactttacattttgctacacatgatctatatatcaatattaaagtataagaagaatccttacactttgattaatttgctaattatacttttatgctacagctcacatttatttcatatatacaccatcatacagaaatgagcttttattacttttttgcacttgagctagaaatgcttttaagaaagttgatttgagctactgcctgtcaaagagaaagttttaaaatccattttacttttcttcaaatgaatataaagagatcttacaatttttagcggtgacttattttcaaatttaaaacttcagatcttataggatgtgtttaaattctgaaattgtatgacttaaataggtatacaatacaaaataagcaggaagaggttaagatattttctcttaatgcaaaataataaagtattcccctccattagtttgggggtgggggaaaacaacagactggtaattattatgcaaatattatggggaaaatcctagctaggaataagtaaattctaagatagtcaccttatttggttcagtagcaagaactgtagatggttgctggagatttaaaactccaaaaactcaacattgacattcaatattttctcactgggagtgtgacattgtgagggctcttaaactttacataggaaaacgattaggaatattattggtcttcagaatgagcatctcaaatataggaaagaaaaatcatggctatatgtgagtacatttttcatatgataatatacacataatttaggttttacctatattgatctaaatgacatataactgattatattgaccaatgattctaggaagccaaagccaaagccagtatattcattaagtgtgtcacagaagcattcagtcatctagctaaacgactgtagacttttcctttatagcatgatcctcgggaaaagggctcattttcaagtttaaacgatagaatgttctggagttgtgaaatgtgaatgaataaatgagcttgtacttgattgtgcttgtagagtgggtatccaagttgtatccccttactttacagaagtacttatgtacatcttcaaatatctttagcgttgttacaccttttgtttgcatttcattttagcacctgaaagtttctgttcctgatgaaatgtctgcagatctaggtaagcttggagcactaacatcctggagaattacatcttaatagatatgtagctcagctcatctgttcaggttttatctgtcacatggtgactagtcgatcacctgaatcacaacagaaagacagtctataatacatttaaagagtaaatgaggccgggcgtagtggctcacgcctgtaatcccagcactttggaaggccaaggtgggtggattacctgaggtcaagagttcgagaccagccttgccaacatggtggaaccctgtttctactgaaaatacaaaaatgagctggcatgatggtgcatgcctgtaatcccagctacttaggaggctgaggcaggagaattgcttgaacacaggaggcggaggttgcagtgagctgagattatgccattaacactccagcctgggtgataagagcaaaactctgtctcaaaaaaaataataatatggctgggcgcagtggctcacgcctgtagtactcccagcactttgggaggccgaggcgggtggatcacgaggtcaggagatcgaccatcctggctaacacagtgaaaccttgtctctactaaaaaacaaaaaagtagctgggcgtggtggcgggcgcctgttgtctcagctactcaggaggctgaggcaggagaatggcatgaaccccggaggtggagcttgcagtgagctgagatcgcgccactgcactccagcctgggcaacagagcaagactccatctcaaataataataataataataataataataataataataatagagtaaatgaaatcagaattctgggatgaaatatacgaactgccctgaagaacttccctctggcatattctaagttaatttgtacgaagtagcattgctatgttgccaattgtatgttgcccagaacatacctttagataacataattcctttcatttatgaagaaaagagaagacctgagctcattcctgaggatctgcatcgccactatatccaaactatgcaagaaagagtccatccagaagttcaaaggcacttagaagattttcggtaagcttagtggtagatagaatttcatatgattattctaaattaatttttttagttaagaaaaagttgctcattaaatacttagcttagcactagataaaccatatggtcttattgttattaaaacataatgaacatctggagccaaagggttagagtggaactgagagtccagactctccattccaggcacttgcaggatctgagctcagtgctgtgtctatgctaagtgtgttcctttaagatattgtatgtgttcttggagtcattgcttctagaattttttcctctggtatcctagatgacatggacccataagtggaaaagtgacatttttcctgttcctagaaaccatagctgtgaagactgtgatgaagcgtccccagaatgaggtagtttttctttaggctacctcaggaaacttctctattcccttcaggcagaaacgtagtatgggactgaccttggctgaaagcgagctgactaaacttgatgcagagcgagacaaggaccgattgactttggagaaggagcggacatgtgcagaacagattgttgccaaaattgaagaagtattgtaagtaatagaagtatatgtggaaatgccctctctgctgagatactagttatgcttgaagtgtcctttgggtaggtttagaaaaactgtcagattgtgtatgtggagccgtttattttgtcatagtacttgagaaactggattttttttttcttttttctgatacttttagataaatttcttgtgttcctttttctgggtggtggtaaatgggtaactctaaaacttctaatcagtgatcaaaaacaggttgattactttcattattttcaatttataggccttggaaatatttcttgccatgaagcatatacagttggtgacatgagggtgaaacagataaggttctttaggggatcagggttcttttggtattttattctagggtgtggcccaaagcatttggctctgttctgttatttcaggtatctgagttaataacaatttttaaggccaggcatggtggcgcactcctgtaatcccagcactttgggaggccgagcgggcggattacgtaaggccaagagttcgagaccaagctggccaacatggtgaaaccccatctctactaaaaaccccaaaattagccaggcatggtggcactcctgtaatcccagctactcagaaggctgaggcacgagaatcacttgcgcccaggaggcggaggttgcagtgagccaggatcatgccattgcactccagcctgggtggcagagtgagactctgtctcaaaaaaattaattaaacttccatatttcatttttaaatttttttttcttttttttaaggatgactgctcaggctgtagaggaagataagaggtaacataactgttttttttcccctagaattttaagaaaaaaagaactatgtttttttcctttcagtcctaaattacaatttatttcttttaacttacaaatacagtttgtggtctctctctggtggcttgtatgttatttgactaatattctactgttgtcctgagtagaattctcttctctgtgcaatgactagttagttctttagtgtttgtttgatttatttcaataattccaaccttggggttttggaaatcatttgatgtctttattctaccaaccctcccttctcagaagtcttaatttacttcgtcctttctcctccagctccaccatgcagtatgttattctcatgtatatgaagcatttgggagtaaaagtgaaagagcctcgaaatttggagcacaaacggggtcggattggatttcttcccaaaatcaaggtaagaatgaaataatgtaatagcatgttcaggccttagggcttctttacatttggttgcagtgtcttccatcatcttagtatttacttaatcagcaaattaatgctagtcatacaaacatttataagatactgtctctgttctcaagaaactcaaaatacagtgagaaatccagacatataaactattattagacaatgtgaaaagtgaaattagcagtttacaaagagtgctatttctgattctgttcatgccttatactttccttttactttgcctaaactaaataccccctgtgttgctacataatcgtcatgaacatctttagtggcagtagagtattctgtcagtttgtaattatttgtgtttttgtttagtgtttactagattgtaaagctgtatgagtacaaggaccttctttattattgtattttcaactgttagcaaaatgcttagtaaatatttgttgaatggatgaatgaattgtttagaataagttcctggtaaatgtgctataaaactaccctttgattttccaaagctgtcagtgataaagagtttgaagaaaacatcttgagtttgaggtgtacacggtactgtgtgcgaacttttaattagtgctctgtgtgcatacacacgtgtacgggttttcatttacacttaacaatttctttgaactaaccattagcattacactatgaaaatcgcaaaagaaatttactctgttacgtatctcttattttttgtacttcaactctagcaaagtatgaagaaagataaagaaggggaagaaaaagggaagcgaagaggattccccagcatcctgggacccccacggagaccaagccgtcatgacaacagtgcaagtatgttgaagtttgaagtgctgcattttcagtactccaggccctcttcacatcagaggcttcttcagctagaatgaatttctggagaaaggagttgttaggatgattttactgaattcccaatatgccttgtttccattcagcgttatttctgaactaagtaccccctatgttgctacataattgtcataaacatctttcgtgggctgggcgtggtgattcacgcctgtaatcccagcagtttgggaggctgaggcaggcggatcacaagttcaggagatcgagaccatcctggctaacacaatgaagcctgtctctactaaaaataccaacaattagccaggcgtggtggcatgcgcctgtagtcccagctactcgggaggctgaggtaggagaattgcttgaacctgggaggcagaggttgtagtgagccgagattgcaccactgcactcaagcctgggtgacactggagcgagactctgcctcaataaaacaaaaagaaaagaaaaaaaaaaaacgaaaacacacatctttagtggcagtattctgtcaaatgtccgtaacatagtttacttacctcttctgattctgtttccattcaacttgtgtttgttaaattaaaaaaaaaaagtgtgtatagatctctccaccacactgaacgtctctttatacatatttacttagtctccatatttctaaaatttctccacctctccattgtactttattttctgatttccctttcaccccaggcccaataaagagagataagctcacttgagatggctgcaggagaaatagggatggtggtaccatggggaggggtcatgtgatggttcttatctcaggcagtagcacatttgaaaatactgaagccaggtgcggtgactcttgattgtaattccagcactttgcaaggccaaggcgggaggatcacttgagcctgggagttcgagaccagcctgagctacatagtgagaccctgcctctacaacaagaacagccaaaataagctgtgtatcatggtgcatgtgtgtagtctgagctacctgggaggctgaggtagtattgctttagtctggggagtccaggctgctgtgagccatcatctcgccactaaactccagcctgggtgacagagtgaaacactgtctcaaaaaaaaaaaaaaaaaaaaaaagatattggcatggtagagtggtgggagtaggattgtgatagtgagtgtcccccacaatgacgagttctccctcaaatgccatgagtgcctcttgttgagaaacattgagaaggtgtgaaatttttagaggaagttaaagagatggaggatttcacagatgctaaccgtgagttccaaggtatacaaaagaagaatttgaggaattaagagattagggtataaaaagttgtgtgagggtgtaggatgctttggatattgaacacctgagtgggagtctttggcttcttgtggtgactttgtgaacaaggataattagcaggatggggattggtctggatggtctttgaggtacattatgatgatgaaggtgtgagtgttgggggagaactggggtgggagcttactaagaactcacaaaaataaagacttcatcttcattcttacaaatgaacacagctccatgtctctcagcattcctcctccctctgtccaccattcctctccttcttttctcatgacccttcttctttccctacatcctcctcttcctcgctttcgtcgtcctgcctcacccctcctccatctcctcatctttctgctctaccttcctctccctttctctcttttcttcttccttccttcatctgtctgtctgtatgtttctctgcataacaatccactatatatattttttagggtctaccatgtttcacacattttaccagattcttttacattgtccttttttgcttttagctaatttgcaatgcagattattttatttattttatttatttatttttgagacggagtcttgctctgtcacccaggctggagtgcagtggcgcaatttcggctcactgcaacctccgcctcccgggttggagcgattctcctgcctcagccttccgagtagctgggattacaggcatgtgccaccacgcccagctaatttttgtatttttaatagagacggggtttcaccatattagccaggatggtctcgatctcctgacctcatgattcgcccaccttggcctcccaaagtgttgggattataggcttgagccaccgcacccagccgcaatacagattattaaccatcattttctgatcagttggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggtgagctattactgtagttcagcttaactaagcatcaagattttaaaacaaacacactaactgaaaaatagagtggcaagttaatcaagactaaatcccagtttaatttaattttgacattttaatatgctacaaccaataagaaatctatgccgaatgataacttaagttctcatttgtccaaaaaaatatttattaagctctctgtcaggcattagctttgtcccggatgttaacatgcaataattatacacagatgcttgcctcatgcagctttctctcttgagagcgatagtcacaaatgtaaaaaatgcaaattgtgccaagtccaatcaagggaaggtaaagggagtattgagggaactggtcagtagttagaggcagatgtgggtatctaaagaagactttttaaaaatctgagattaactagaggttttatttttcaatgttaataggaagccagctgaaagaaagggtagaatatgtgggagacagtatataagtagtagaacagagttgtgaggagagaggagatgagatgtagagtgtatgtaaagggtaagactatttactgagagtgagagttcagtgagaagagcaagggaatttgaagagtaaagaaagatatgaagcaatcgtaggtaattgggcaaggagcttattaccatgtcttcatccttgtttgggaggcggttcaatttctggtggtgacatgatcaagaatgaggctctgggagtggtccctgaggtgccatagaggaggctactagggatgaagacggcaaggaaccaagaagccaggagtttgaatagcttaatattcatggctagtgacgtcaccaagtgtgatttttatcatggagaggaaaactgtgagccaccagccaaaggtttagcattgctagatgattgatatgaggaggaagagaatgtgataatatccagagcatgagagcctcagtggagcaagagattatacaggaagacaaggtcgggtgcagtggctcatgcctgtaatcccagcactttgggaggctgaggcgggtggatcacctgagatcaggagttggagagcagcctggccaacatggtgaaacccggtctctactaaaaatacaaaaattggccaggcatggtgacatgcacccgtaatcccaggtcctcgggaggctgaggcaggagaattgcttgaatccaggaggtgggtggaggttgcagtgagccaagatcgtgccaatgcactccagcctgggcaacagagtgagactccatctcaaaaaacaaaaacaaaaacaaaaaaaaacgacaagataatggtccaaaaatcatattgaggaacaagaaggccattcatctcatctccaccctgacatacaccatataagacagaaatattagtttctgtctcagagggctgtagcagaagaggtaagctgctgggaataggcaggtttctacataaggccaagaagtacaagtgacatttggagaaaattctggggattttgtcaaatatggaactctgaagatgttagattgggtatatgcactgatatttcatggctcctgtgacttattaaaataaaaacatggtaggtggcggatgaacagaaaccataaagagaaagaaagtagaggaagggaatgtgttatcaggaaataagagattttaacaaatacttgggagattgaaagcagacaagagtgtaaagaagccaggcatggtggcttactcctgtaatcccagaactttgggaggctgaggcaggaggattgcttgagcctagaaattcaggaccagccagggcaacatgaaaagactgtctctacaaaaaatgaagaagtcagccagtcatatggcatgtgcctgtagtcctagctaatcaagaggctgaggtgggatgatcacttgatcctaggaagacaaggctgcagtgagccatgttcttgccaccgttaatgcagcctggatgacagaatgagaccctatctcaagaaaaacaacaacagagaaccacaagataaaaccataaaggaagccagagcccacaatttgtttaaacagtccaagatagaacccagtctgctcattggaaccctggagagactttgggctcagagttagcatatgttatgcagtgcaggaataagaaaaagagcaaaaatgatgaactaattgcaggtctataatcaaaatagttatatcagcagcttctaatccctgaattacagagtatgagcagtctctgtcacttgtagactagaagaaaaaaacagtgctcttttttaaaataattcagtgaattgtgtagggagagttaagtccctccgcagtattgatcgcttggagttctgacatttgggagtccaaagcctgacactaggcatgccggcaacccactgtgctcagagagctctcaactgaaacagacctattactatatagcagcaaaagaaagccaagtcagctactcactttcatcattaaacacgaacatcattactcacccttgtcagagtcaagacgtaagataatatataatgccaaacatatcagacaatgacataaagagagaatacagttaaacagaagaattttccctacaagagaaagataatctgataatagacaagaacttaagaaaatacttctaaattaggtagtatacttggggacattaaagaagttattatctctataaagcaagaatagggagcattcagagacaaaatatttttaatacaactattaaacacagtgacatctgttgtattatcaatttctgtgtgataaattaccccaaaacataatggcttaacacaaaaaaaatttatctcgactttttggtggatgaaggactccagagcagcttagctgcgtgggtctcggttggagtctgtcataaagttgcagtcaagatattagccagtcatcagaaagcttaactggggctggggaacccatttctgtgcccactcaggtggctgttggcaggaggccttagctcctcactcatggccttggctccttgccacatggacttttccatagagatacttgagtgttccatgaaatggtagctggcttttcccgagtatcccaaaaaagagagcgaaaaggaagccccaatgtcttttctgacttagtctctataggtgcactctgtcacttctgcaagttagaaacaagtcactaaatctagcccatactcagggagggaggaattaggctccacccctgaggggagaaatatcaaaaaatgtgtgggtatattttcagaccaccacagcgatcagagtttaaaggaaaaaaaagaagtccctaaaattaaagtcaaggaaatattttagagtgtacatcagaaatatgaaaggatagaaatttgagagaaaagaattatatagggaaccactacagagagccaacatctgtctctttcacaaaaagtcagctgaggacatggagaagagatggttaaacaacaggagaaagtttcccagagttgaaaaagaatacccatcttcaggtggaaagggctcactgagaaccatctatagtgaatgctttttaaaaaatccattcctaacatgtcctttgaaactgtagtgcaccagggataagctttcagaggaaaaaaaatggggattacactgcatcacattcctcatcataacactggatgctgaaatacaaaagagccatgccttcaactttctgaaggaaaatggttttgaacttagaatcctgtatccatccaagctattcatcaaatatgaagaatgaataaagacattttcagatacacaaggtccacagtttaactggaatgtacctttccctttgaaatcatttgaggatacacattctagcaacatgagaggaaaaattaagaaagaaaatgtcctgggatccaggaaacactggaaacacccaggaaagtggcaaagggcaattctaaaatgatggttgtgtaacaggccaggagagccactgctccagattggaacacaagaacatcacagataagaaaatggggattttaggcagtggatagtatgaagcagcagaggaaatagtttgagacttgatagaattatataactttgacagcaataaaagaaaagcatttagaaatgttaagaaaaacagaattgttcaggaaaataagtcatgatttaaacatgaagcaaaataaaaagtggcatgatctttagcaattgatggtgtgtaagaaagactttaataaatgttctatttgaagtggcccatggattgcatcattggaccggtaggaaaaaatatataatcctaactagtatatttcttaatctggcaggaatgatgtatatatgtatgtagtagacgacagtatatatatgtcataagcattctttcttggttttcagacttttagaataaccctaccaggcaagcatggagtagttcattatggctgcaggttagaatataaatgtaaaaaattcttttaatgatgcaagtaaaaatgtagttgaaagaaatggaaggtagaaggaaggaaatacaattagagggaggatgtggacactgaatacctaatctgacacagaagagagttgagatactaactttttgatagaacaaaaacatagacatgtcatttaaatttaggtagtaactaataacccagctagtaataatgataaaactattaaacattgggaagaaatggtagaaaagtgaaagtggaaagtgtaagtcaacaaaatcctcagaggggaaagaaatagatattaactaaagataataaatcatgaaaaagaggttatttgtagttggaccactgtaataactcacatttgaaaacatgaaaaaggattgatactgggagtagaaaaggataagatgggaaaatgttgttcctcatcatatactcttctgcactgtgtgagtccttgctatttcttacgttaatttttaagaaacagttttaaaaattatttttctgaccaggcatggtggctcacacctataatcctagcactttgggtggccaaggcgaaaggattgcttgagcccaggaattcaagactagcctgggcaaagtagcaaaaccctatctctacaaaaaaattaaaaatgagccaggtgtgtgtggtggcacgcaactgtaggccccgctacttggaaggctgagatggaaggatcatatgaggctgagatgggaggatcatgtgagcctgagatgccataattttgtatattaaatttttagttctagtgaacctgcagttgtttaaataagaatgtagctatggattaggctgaagctgttctgggaactaattttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatggtgagtgtaatcaatttgttgttgttgtttacaaatactgagttttgtcagagtgaattaagtctctcagccttggagtttgcttcaaagtttctcctagccttttgttttaaacaaagaggaaattaaactggacagataatccttgaactcaagaaaatgcaaatgtttctctgattcttattgataatttaaaaggaaaatgtgttaagccttaaagatatttaagattcatagcattatagatcttaaagttgaaaagtcattgcaacaactaagttatttttatgcatagattttaaatgaggaaggtaaagcccagggagattgaattcgttaagatcatacagctaataacgtgtaaggaaaaaaattcagttcctggtctttctgtatcgaagtgcagtgttctttatttaccctagcatgtatgtgataaatgtgtggcatgggtgctgtaccctttactatccttagcatgtgatatgaataaatatcttgtctctgacaatactgagacataatgaaattataagcctgaccccagaagtgagtgtttataggcaaattagataaccaaaagtactattatttcttaagagggctcaagttaaaggctatatgatgttggggcttacagttttcttaatgatgtagttgtgataggtgggtattattgtaaacagctggatgtgtttgggaatacactaaaaaaaatagttttgaatgatattttttatttgtcagtattcaactctcagagccagtatgtaggaaaatttcttggaatcagaatgacttcagagatatttcatcctttctaaatgataaataatttattatataattcatttgctacttcactccagctaaagactatgattgatcccatggaattgttctaagtaaggcaacatttcatatctctttcctgttcagaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatagtaagagaaattagctctgatctttgcccctaacatttccaatagagaaaagattgtgagtttaaaattttgtaaatgtacccatgttagtattcctgagattatgtgtgagaatgtaagataaataaaggaatgattggaactttgactagatccttttcctcacaatcaatctttcatgtacaatgtgtcaacatagggcttccagtctaaagtcattgcctaaggtgaaaaacatgaatagtcaaattcaccgttgaaaattttctatcaattatagtatatatatctctttaaatatatatatccaatataataatatacgtataaatgtgttttgtaaatagtagtgtatggtatataatcacatggttcggtaatttttaggaattgtttttatttttttgagatggagtctcgctctgttgcccaagctggagtgcagtggtgcagtcttggctcactgcaacctctgccccctgggttcaagggatcctcccacctcagccacctgagtaactgggattacaggcgtgcgccaccacacccagctaatttttgtatttttcgtagagatgggtttcaccatgttggccaggctggtctcaaattcctgacctcaagtgatccacccgcctgccttggcctccaaagtgctgggattataggcatgagccactgccccggcctcaggaattattttattgttttgttgcttggaacacttgaataagtatataaaaattctaccttgttgacattttattggttgaagtcatcttggacttttgtggacagtaatatgatgttcctctcatttataggtcactatttctctatgacccttaatttttttatctttctttttcatgtcatcactaactatcaacatctgctaactaaattgatgccttttattcctttgtggataatcttgggtttcacaggcatgcattgacaagttcaggcttgattacatccattgcctgcacacttaacacattttgagaggatcagtgaacagaattacttgtactgtttaaattcaagttctttttgagcatgattatagatggagtcttgaggttcaatgaatatttgatgcaaccaccgtgtatgtaatgtgctagtttccaaaaatgttttttgtttagcacctgtttttcagatagagcttataatatccagatgtgtaagcactatgtccagatttatatttaaggagataagaagcagctgtactactgtgaaaatcgtctttataaaaaaaaaaaattagctactctgtactaccagtaattctgtctacactgaatgtgttactaacgtttttctatctttttatctttagttggattgaatgaacaaatgaaggctgttcgaaagagaaatgagacctctgttatcgatcagattggggaagatttgctgacatgggtaaggaaattttctgtttctttttaatatttttatggacacttgatggttagattcaagttgagtaactaacctttccaaatatgcaaactcatccatgttgcaaagttaatgcaaagctgagaaaggtcaagcagtagattccatttcaagaaaccacctgttttgctcatctgtaagaagcagacccttatccattaaaagtcataccatgagattgcagtgattcagtcacaccttcaggctccactgtaatcctagtttttttgcagttacctcttccactgaagtcttgaacccctcgaagtcacctatgagggttggaatcaacttccaaactcctgttaatattgatattttgacctcctcctgtgaattatgaatgttcttaatggcatctagaataatgaatccttttcagaaggtattcagtttgctttgcccagaccaatcagaggaatcaccttatgaaatatatttcttaaataataagacttgaaagtgaaaattactccttggtccatgagctgcagaatggatattgtgttagcaggcctgcaaacaacattgatctccttgtacatctccatcagaagtctttaagtgaccatgtgcattgtcaatgggcagtaatattttaaaagtaactttttttttttctgagcagtaggtcttaacagacatgctgtcatctaggctttgttgtttcatttatagagcacagacagagtagatttagcattattcttaagggtcccaggaatttcagaatggtaaacaatcattggcttcaacttaaagtcattggcccctaacaagagagctggcctttcttttgacatgctgaagtcagacattgatttctcctctctagctatgaaagttctagatggcatcttcttccaatagaaggctatttcatctacattgaatatctgttgttcagtgtagccactgtaatcaattatctcaggtacgtcttctggataacttactatagcttctactgctatatcagcacttgctgcatcactttgtacttttatttttatggagatgacttcttttcttaaatctcatcagtttacccctgctaccttcaaactcttcgtctgcagcttccttacctctcagccttcatagaattgaagagaattaggggcttgctttgtattaggctttggcttaagggaatattgtggctgatttcatcttctttatacagactaataggctgtttcactttcctcttgttcatttgttcattggagtagcacttttatttccttcaagaattttttctttgtgttcacaagttggccatttggcgtaagagccaaatctcagcttttgacatgccttccttactaaacttaatcatttctagcttttaatttcaagtgagagatatgtgactcctcacttgaacccctaaagaccattgcagcattgttaattggcccaaattcaatattgttgtgtctcagaataaggaggcccaaggaaagggaagagagttgggggaatggtcagttggtggggcggtcagaacacacacaacatttttccattaggtttgccaccatatgtgggtgcagttcatggtgccccaaagcaataaatagtaacatcaaagatcactgatgacagatcaccgtaacagagtaaaatgaaacagcttaaactattatgagaactaccaaaatgtggcacagagacatgacatgagcacatggttttggaaaaacggcaccaacagacttgctcagggttgccatcaaccttcaatttgtaaaaaatggagtatctgcaaagtacaataaaaatgtgaggtatgcctgtacctgtaaaaagttgaggaaaagcagaatggtggtttgtaactgtcacatacaaagcgttaatttagaagaaggcattggccagaaatcataaaagcaaaaatcataaataggcctttagattttactcttgctgtttaaataaaatcattttggaaagtatttttccagtattgtttccttaagatcactttacatacacagacaatccttgacttactatggttccaacttcgacagtttttttactttacagtggtgggaaagtaatacacattcaatagaaaccatactttgaattttgaattttaatcttttccggagcttggcaatatgtggtatgttactcttgatgctgggcagcaacagtgagccacagctcctggtcagccatgtgatcacagggtaaacaaccactctacagtgtactgtactgctagatgattttgcccagctgtaggctaatgcaagtgttctgagcacatttaaggtcagctaggccaagctatggtatttggtaggttcagtgtattaaatgctttctcaacttaagatattttcaatttttgatggttttattaggatataagttcatcagaaatcaaggaacatctatacttaaactgcttgtaaaactactgtagaggccgggcgcagtggctcatgcctataatccctgcactttgggaggccgaggcaggcagatcacctgaggtcaggagtttaagaccagcttgaccaacatggagaaaccccatctctactaaaaatacaaaattagccaggcatggtagtgcatgtctgtaatcccagctactcgggaggctgaggcaggagaatcgcttgaacctgggaggtggaggttgcggtgagctgagatcgagccattgcactccagcctgggcaacaagagcgaaactcagtctcaaaaaaaaaaaaaaaaaaaaaccaaaaaaaactactgtagaactgcttgagtttgggggcattattttctttggtaaacccagctgctttttgtagttgtgtggtgctttgattgactaacatgctaaaaatgctgccagtctccttgttaaacatgttaaatgtcatattcatcatagagtaagaatacaaaattggagtgacctattaaaatattgctttgtatgtgtcctacttgaaaaaatactctgaatttatctacaaatgcgctacaggcgggctttttacaaaatgcctttatgtacaaacttttgggaatatggctttaaatggaagattatatggaaaacatcttcgtaaaccataaagcaattatctacaagtatagaggctgtattaaaaaacaatgtatttgacttctacgagcacctactagtaaatcactttttaggtgtttaaccatcagaaatcttaaaatcatggcacatgcaaacttaaatttacaaattaaaaaacattagtgagaagtataatttttagcaaaagaattcataagctcattgatctcccccaagccagctccagctgctgcacaggtgaaacagcagtgatttaattttgtttcaacacagaaaacttacggcctgcccatggtcatagtgggttttatactgagtaagaaggaatgctagtatgccaaggatttgcttcccagagtagtaagacagtagttgttgtaaaggcttcagggtgtaagaaaattaaattttaggccagatgtagtggctcatgcccataatcccagcactttgagaggccaaggcaggcggatcacttgatgtcaggagttcaagaccggcctggccaacatggtgaaaccccatctctactaaaaatacaaaaaaaattagccaggcgtggtggcacacgcctgtagtcccaactacttgggaggctgagacaggagaatcactggaacctgggaggcggaggttgcagtgagctgagattgcaccactatactccagcctgggccacagaatgagactgtctgaaaaaaaaaaaaatgaaaatttagtctcagtcttcaggcattttgtatcttatattctccaaatgtcagcttgtctgtgtaatttataagtaacgtaggctgaaaggtaataggttgtgataggctacaagcaagaaaacattgggactgggcacagtggctcacgcctgtaatcccagcactttggggacaccaaggtgggcagatcacctgaggtcaggagtttgagaacagcctggccaacatggtgaaaccccatctctactaaaaatacaaaaattagctgggtgtggtggtgtgtgcctgtagtcccagttacttgggaggcagaggtgagaatctcatgaacctcagaggcagaagttgcagtgagccaagatcatgccattgtactccagcctgggcgacagagcaacactgtctcaaaaaaaagaaaaaaaaaagaagaagaaaacattggaatatgatcagaaaaggtctggttgtgtcaagatcagacctttttaatggagaaccattgatattccacatagatatgcagttctgtgtattttgtcacttgaaatattgaaaggattctggttgtctgtcactttgtctggcttgtataagctcagtttcccattctcttttgtgttctttgcattcttggcacagttcagcggaccaggagaggagaaattgaaacatgctgctgctaccttttgcagtaaccaacctttcgccctggaaatgatcaaatctcgtcagaaaaaggattctcgatttcagacttttgtgcaagtgagttgagtgagtcatgtaagaaaaaaaataaggcaagtttttatcaattatcagataaactgggggaattctgactaagacttttacaaagattacatctgtgttaactttttttttttgagacagggtctcgctgtgttgcccaggctggagtgcaatggcacaatctcagctcactgcaacctctgcctcctgggttcaagcgattctcctgcctcagccttcctagtagttaggattacaggtacatgctaccacgccctgctaattttttctatttttagtagagacggggtttcaccatgttggccaggctgggctcgaacacctgacctcaagtgatctgcccacctcggcctcccgaagggattacaggtgtgagccactgcacctggcccacgttaacatttttaaaagcaatacattatctcttaaattcctggaaggtacaaaaatgactttggaatggtgaagaataataaaaaatatatgtcaggattaaaatacttaatatagaaatccacattgccacgaggcttttatcagtaaacaaccgtatgctctattaagagaatattgtcaaagcatgagaatgggtttatccagggaaaaacgtaacagcagccacactcattggggtatatgaattaagggttggtaaactatggccgacagaccatatctagtctgttacctgtttttataaagttttatgtaaatacaaacatggccgcttgacagatttctcacagttgttgtggtgtgtgggtatggtttagcaggttcctcccttgagagtttgaccaggctgagatcacagcgtcagcgggagctgcagttttcatctgatgctcgaggttctcttctaagctcactggttgttagcagagttcatttctttgtaaatgtataactgaggtcctaccttgctagctattggctaggaaccagtttcaactcctagagaacagagagatctctgccatatggccccattaggcagtttagaggtggatgtttgctttcttccaggccagtaggaatgtggctttctgacacagatttgttttaaaggctcctctaatgaaatcaggcccagccaggataatttcctttcttatgatctcaaaatcatgtggtggcaacctaatcataggtgtgatatcccattgtaatcacagattccaaaaatgttcatactcaagggcataggattacacagagtatttacacaagaggatgggaaccttggaggccatattagagttctttactacacagagccttgttcattcacttatgccaaaacagtagagctgaatagttgtgagagagactatatggcctgcaaagcctaaaatatttactatctggcattttactaaaaactttgcagaccactggtatagatgagctggcatactcgactggttatccattgtgcatacttggaatggcagataacaaattagctaaccaattttggtaggaatgtcaatcataggagaatggacctagattttctgaataggtgaagataaaactgtttcaacacaaggaagcgatacgtagagctgcttatggatgctttcagtccttccttaaacagataacaagccattcatttagtaatagaggctcccttcccccattatgtgattaaaggagaaagcagaagtatattgtggcaatgatatatcttggcattttttaaagatcttgatttaataaccagaactgtgatgcattaaaccctcacggtgaatacatggtacatgtataagttcaaataagaattacagattcacttatttcactttaattttaggatgctgaaagtaatccactgtgtcgtcgtcttcaactgaaggatattattcccactcaaatgcaaaggcttactaagtacccacttctgttggataatattgccaaatacacaggtacagcattttcactgaaataaaaagcttaagaacaacaacaacgaaacacccaatatcctgtaaataatatcttacagcgtcctgaatggagttggatttccaaatagtatgacaagattttctttttttttttttttttttccttttttgagacagggtctcactcagtcttgcaggctggagtgcagtggcacaatcatagtttcctgcaacctcaaactcctcggctcaggcattccttccacctcagcttcccgaacagctgggactacaggggtacaccaccacacttggctttttttttttttttttttagcaagggtctcactatgttgctcaggctggtctcaaactcctggcctcaagcagtcctcctgcctcccagagtgctgtgattataggcatgagtcaccatacccagccaagattttctaacaagatatgatctagtcttcttcgggctgtttgatataatgtactccattagtagctttagtacggggtatatcaaactatgaatcatagaccaagtcatgctcactgtctgtttttgtaaataaagttttattggagcacagccgtgctcgtctgtttatgtactgtccctgattgcttttacattataacagcagagtcgagtagttttatcggtgcccatttggcctacaaagtgtaaaattatctggttcaaccatccttgttctagcctgcatcatttttgctttgaagaaggttcatccttggctgaagagatgtttcatggatatctatcaatgacttttattaagccaaatcaatgcggtgtaattccaactctcccgttttgaaacatgaaatgaatctgtttctcagctgagctttaggttcttatacttagctctcattaataatttaatgcaactgaaatcttgtttcttgtgcctgagaatttgaatgcataagcaggaaattttaaattatggtacctggtaacaaaagtggtttacactcatacatattaatttttacactttaatatatctgctcagtgtagttagactgtggtttggaggattataattttgaatgttctgattttggtcttctttgtattatagacatgacatagcctcaatacgttttgtcttgttttgttttgttttgttttgtttttttgagacggagtctcgctctgtcgcccaggctggagtgaagtggcacaatctctgctcactgcaacctccacctcccgggttcaagcaattcccctgcctcagcctcccgagtagctgggattacaggcgcacgccaccacacctggctaatttttttgtatttttagtagaaacaaggtttcaccatattggccagactggtcttgaactcctgacctcaggcagtccgcctgccttggcctcccaaagtgctaggattacaggcatgagccaccttgccttgccgcctcaatacgttttgatgaatttcatcttcttttaatgtaatctattttctttctttaaatataatctcaaattcaaagaaacttgttttggaattattttgaattgtgttattaaaaaattttgtttaacaagttcactggacataattatgtaggctatgcactgtgaaattctgaggggagaagggatttccatttatattatttacaaagtaaatgagacctgcccttctggagtgtatagtatagtggtcctggtacttcacgtaaagcatctcttcttggatttcgggttctgtactgtgatttctttttaaagattagaatttatgttttaaagtcctgttataagaagttttacctgtccaaagactgcttgaattgagactctgacagaggctttaagctggtacaaaaatcttcaaggtcttaatatgctcttaaaagtattgaaatgaaatgaaatctcatttacatatattttatggttttttgctcagttcttttacattttggatttctttcccatatttagaatggccaacagaaagggagaaggtgaagaaagctgcagatcactgtcgtcagatcttaaattatgtaaatcaggctgtcaaggaggcagaaaacaagcaggtaaaaaaggaaaacaagaaggtacaggatgacattgggagaacattaaattaatattacctggaatctgtgaaatagttgttaaaactatcattacctaatggacagggagaacatttgtttactgttcgcatagtaggcaggtcaagatcaatctgtgatagaatatcggagttgtatttgactttttgaaacacctcaagctgcttgtttgctctttcatttatctcttcattcagcagatatttatagaacatctactgtatgctgggcatagggtacagagtagttgagaaaatgagtgcaatatctgcccacactgagcttgtttgctaggaggatagaaaggcatttaacaggattatagtgcaaatattttgtatcagttgtgatagctactatcaaggataatttcaagatgctacgatatataactatggggcctagcttagtttggggatgttaggtggtgcctattagagaaaattttcttgaggaattgacacttgagccaagctctgaaggatgagtggaagtgaaccaaaatgatgtgaagggtgcaaccctagaggtagaggcaatatataccaaagtcctgacggaaaaagaaagcatggtctgttggaagaattgaaaatttacatgagtgtggatcatgcctaaaaagcaaagtcagagtggcataaaatgaggtaaagtagaccaaggccaactcataaaggccctagagatcaggttaaagattttgatttgtcttcttaagtgcagtaggaattcagcatagacaagtaagaatatagtgttcagattttcattatctgaactagtactctatggagaatgagttgaagaagggtggtggatgaaagagcccatttattaacctcttgcagcaatctaggatagatgatggcagcttagagaagttggagaagtatttagaaggtaaaattgacaggacttgatgactgatttgaagaaggatttgaaggaaaagtgatgtcaagaataaacccccaggtttctggattgcatatttggatggacaggatgagtggagaagccccacgtttgtggggaagatgatgaggtcactctgggatatcaggtagacatgcacagtaagcagttggctgtatgggcccacctctaagaggaccatgttgaagataaaaattcaagattgtgagcatacaggggctgattgaatccgtgaacacggatgtagtttcttaggagctgagtatgattacaactctcttggtgaggctgtagaaaaactagtactttcagctgtgctgttcagagtgtaaaatgataaaaccccagagggttatgtagcaatatttatctaaattaaaactctgtaggtacccttatatctaccttttgactccgcagttctgttcctagtgatttgctcaagagaaatgaaccatattagagttctttactacacagagcctgttcatttatgtattatctgtggctacttttgttccaaaacagtggagctgaacaactgggagagagattatatggcctgcaaagcctaactgacattttactaaaaaccttgcagacccctggtatagatgagctggcatactcaggctggttatccattgtgcctgccgggaatggcacataacaaattaactaactaactttagtaggaacaccaatcataagcaaatggacctagattttctgaataataaaatatatctttatctgaagataaagatatacccacaaacagacttagaccagaatgcttatagcaactttattcataatagcgaaaagctagaaacagcccaagaatttatcaacagaatggataaaccaactgtggtatagttataaaatagaatgccctgagtgataggaaaggaatgtaccactaaggcacacaacatggatgaatctcacaaacatgctgagtggaaaaaaaacagatgcaaaagagtacatacctatgattccatttatatgaacttctaagagagaccaaactattctatggtaggaaaaaccagaaaactggttcccattggggatgaggaggtagaaattaactgggaagaagtatgaggaaactttctggggtgatggtaaaattttctatcatgatagaagtttaggttacacaaatgtgtaagcacttgtcaaaattcatggaacatacacttgaaatgtgtgttctactgtatgcaaattttacttttttaaaaagaactgtatggatgtttaaatgtttagaggtaaagtgtacttatgtctgtaatttattttgaaatgcatccaaaaaataagatggactgatggatagagggatgaataaatagatatatgataaaacaaatagagcaaatgttaattgtagaatatagatggtaatatataggtgttcactatgctcactcagacttttccatgtatttggaaatgatattgtgggggaatgtacataccctttgatccaacagttctggaaatttatcctacagatatcctacatggatgtacaaagacatatatttaagtccactttattacagtattgtttgttacagaagagttgaagtaacttaaatgcccatcagtaaggcgtaatgaaataaattatagtttattcagagagttttacatcctgtagtcatttataaaaaaatgaaataactctctatatgtgctaatgtggaacagtccccaagatataagtcatacaccacacacacacacacgtgggggaatacgtatatgaatgtattctaccatttcaatgaggaatacatataggaataccaaaggaatgcatatatgaatatattatgctaccatatcttgttttaaaaaaggacatatacacacaacatgcacaaagacaagcatacttatatatacatatataaataaatacatatctgtttgcatagaatttttctcaaaggctacccaagaaatggatattagtgattgcttctttagggaaaattgaggggggtggggcaataggacaaggttagagggagactttttattttttgccttatatagccatctgaattttgtactgtgtgcatgatttacatattcagaaaataaatataagctaataagagaccaatgactttgaaaagaagattgagaaagaaaagccaaagaggcaggaggaaaactaggagagtatattatcaccaaagccacgggaagagagtgagttttcagtcctgtctagcattgcaaagagctcagtaaaatggagattttttttttttgagatggagtcttgctgtgtcgcccaggctggagtgcagtggcgtgatctcggctcactgcaagctccgcctcccaggtttgcaccattcccctgcctcagcctcccaagtagctgggaccacaggcgcccgccaccatgcccggctaatttttttttatttttagtagagacggggtttcactgtgttagccaggatggtcttgatctcctaacctcgtgatccacctgcctcagcctcccaaagtgctgagattacaggtgtgagccaccacgcctggccaaaatggagattttaaatgccaagtttgattcagaaatagagaggtcattaatgaccaaagcactaaccttggttccaccctgcctaattttcagcgcctagaagattatcagcgtcgccttgatacctccagcctgaagttgtcagagtacccaaatgttgaagagctcagggtgagagatggtctaatcataatttaaaaaataaaataaaatttgctaaagacctggcaggtaattaacatctcagtgggaatatacgtcacctgaaggagttcttgtatcgtagattatctgtatttatgattttttttgctgccttttaaatgcttgatctgtatgaaattagtttttcattagaggaatatcttgcataaaactgtaatattacatgacagcaattggcaggagactaagggacactaattattataaaatttaattttattgtgttctgtagtttgtttcagacagggtcttgctctgttgcccaggctggaatgcagtggtgcagtcttggctcactgaagccttggcctcctggactcaggcagtccacccacctcagcctccctagcagctaggactataggtatatgccaccatacccagctaattctgtgttttgtaaagacaaggtctcgctgtgttgtcaggttggtccagatttcctgggctcaagtgctcctttctcagcctcccacagtgcagggattacaggcatgagccactatgcccagcctgtgttctgtagtttaaataagggtaggactgtttggtaactttccagatcatttaataacacaagatagcatactattttctcatgaggctcttcagaagcataaaagttggaaccattacaggaacgatagtaaaatgtttactaattgccacttctagtatgtgggcttatgtgttaactttttcggattttaagtgtttttgtaccatttcactaggtggtggttttggcagatttatttggtggctgttaaaatagacttttatgtcatatattaatacttcgtcaacaagcacgtaaatgtgcttattccccttagcttccaaagaatgagagttttctagagctgctaatactaaaagatgattctcttactaataagttgttaatatttagaccaagtctgagtagtacctggacttttcatgagtactatttcttagaactttctttgaaattagagccttggaactcagaagccactttcttatagacaagcatatgtaccatgctcatccagttattcataggaaaattaaaggatacgttgagaatctagtgactgaatgtttgtaacttgatcttcataatctgttatcatctgtttagagtgaggtttgaagatagtactcctgaatgttcttctgcaagataccttttcctttttagaaaattgtatgcagattactttaatatggcttttgtgccattttcaagaactgacaaatagcaataatgatagttgaatgtaaatggtgtattttatattaagaatttctttaaaagagactgtattatatagataatcatgttactgagtgcttggaaattatttgtgcatgattttctttattttgccagaatttggatttaacaaaaaggaagatgattcatgaagggccattggtttggaaggtgaatagagataaaactattggtaggtctgatattgtcttttagttttggggagagtggcaaaagggaaggaataggaaagtttcctatgacaaagggaagaggagagaaccattctctcagcagtttgcagtgctacctcgtgttatttgtacatttgtagatctgcttgtgttatttcattatatgtaagatgtgttaaatattcatttaggaatgtagtggagaactgatttagtcctatttccatcattcttatagtctagtgagtctttgtatgctttgtaagctttctttagaccagtacatcttaaactgtctgtgatgaggaaccgtttttgttttttcagaaacaaggtctttctatgttgcccaggctggagcacagtggctagtcacagatgcagtcatggtgcactgctgcctcgaactcctgggcttaagggatcctcctgccttagcctccctagtagccgggactataggcgcacagcaccacacccagcttgttgttttttatttcctattggtcacagactgacacttcagtgaaataaaataaaaatgaattactgaaaatgaaattttaaaagataatatacaagtcaatttttaaaattttgtagctttaacagaaatagaattcctctgttgaatcattataaagttaatcaaacgcgtctccatttctgtacttaccatttttttctgcacttttatttctagatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacaggcaagtatgtccactgaaggatactaatttccagattcattgtgaagttgcataagatactcggtgctgtctcaataacacaagtggcatagagtcttgctatttttatattcttaagcaaattacatgaaatttactgcttagaaagagacctaagagtttataccccaaagttattagggtgtctcgattctgtgaacagttttctgcatttgaaaatttttatgctattactttggttctttatgttcaaatcattgatagatcccaatgaaaagcctttcatttagggtggtatgttttttgatttggtgagaaaaaaatcaaaaaccaaagagacggatgtagtgttgattaaaaatcaaatttgactggcaagttatattttaactctattaacaacggggtcccttttaaaacttgttagtttcatggtggcaaaataaatttgtgacctcttttctccactactcactgaatattattaactaacaacttagcaaaagtgcagttcaaaataaatgcaaaagagtaatagcatttaatctggtaatttggatttatttattttttttcttttgagacgagggtcccaccctgtcacccaggctggagtgcagtggtacaaccttggcacactgcaacctccacatcccaggctcaagcaattcttcaacctcagcctcctgagtagctgggactacaggcatgcaccaccatgacctggctaatttttttgttttatgtagaggcagggtttcgccatgctgcccaggctggtctcgaactcctgagctccaagcggtccacctgcctcggcctcctaaagtactgggattacaggtgtgagccaccgtgcccggccagtaatttggatttttgacatgcttttagcaaagtttctagtaaattattgtggaattagtgctaattcgtataatctttgttttattgaagtacaataaatatagtacaataaatacgttaatatggtaagttgcacaaattttaagtgtacatcttgatgaattttaaagtaaatatatgtaacctttatctagtttaaggggcagactatttcaagaccctaaaaacatccctcatggcctccccaggtcatagtattagagtaatcttgtattgttttttccagataacaaagctttattcgtcatttccatgtcagacaatggcgctcagatttatgaactggtggcacagacagtttctgaaaagactgtgtatgtatcagatatggctaccttgctatagctaatattttcattatcccaagcgtaatattccataaacttaactttgtttttataatgtatggaaaccaagcacttcctctgtactcttttagagacgttctactatgaacttgttcttttttaggttgatgccttttattttgattctattctgaaagtttatttcctaaagaaaaaattgtgcaaaatgtcaagtgaagtttttttaatgtgtccatagatttctcttaaggtatagttttggactctcgccttaatagtgtgttgccaaaataaagatattctctggcagagtgggttttgttgttgttgttgttgttgttgttgttgttgttgttggttgatttggtttttgtttagttttgctttctgagtatatttaaaggatatttcttttttcttttttgtattttggatttctttccaactttctgaagctggcaggacctaatctgtcggatggctgcatcagtgaaggagcaatccacaaagccaattccattaccacagtcaacacctggcgagtgagtgttcctttgcattgtagtaggacttattttatgttttgggttggaaaagactaggataattattatgttttgttgcgatgatgtttagatacctcaggaaggtaaaagtttttttttttttttttttctctacagaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagataggcgtatcacctgaggccaggagttagaggccaacctgaccaacatgacaaaaccctgtctctactaaaaaatacaaaaattagccgggcatggtggtaggtgcctgtaatcccagctacttgggaggctgaggcagggagaattgcttgaacccaggaggcggaggttacggtgagccgagatcgtgccattgcactccagcctgggcaacaagaccgaaacaccaaaaaaaaaaaagaaaaaaagaaaaaaaagaaaataaaataaaatgcaaagaaactttaatactgtttggtttatgcaggttccagcatcagagattcagtttaacaaactttgcctttgagccttctgtgtgtcagtataacactgttctaagtgatgtgtatttttcttaacagatgatctctgtagtttatggattgttttttttttttctgattcttccctgaatgcttcatgttaaaagttaaaagctttgtttagatatagtctaccttttctattccattggacagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaattgtaagttttattcataacttattacagatacttactaagtatgacactcatgtgccatccctaaagtatgtggatttatcaaactccacttattcttctagttctattgtggagattatagtattctctacagtggcccatgccacaggcacacacacacatgccactctgttagctccccacccccctgcctggttcagaatcactgttaaaatgggaggatagcatatctctcagttgtattgaggtgggaaaaaggctgagaacaatttctttggctggggagaaccacttgaaatttttaaaccagcgtatgactaaaggtatgaaaaaagattaatctggctgaaagcggtggaaggatttgaatggaaagaggtatggaatggtgtacttactaaataagctattataatagtctggcctgagactaaaagagtttggactagaatgttatcagaaggaataagaagaaactgagaagtcatcaaatgcttaaaataattgacttctttgaatgtgaggtcaaaggaaagggaatatttagagataatttcattaatctagtcagaaataagagtcagaaaaggactaccactgcttcccccacctccttccattgtactttcttttttctttcttttgatttggtagaattataggctcagttttaaagcatgtcaagattaagataatgaatgacaaaacactaaaaagtgagtaactagcaggaagttagagttttaggagtgaaactttagagagaggttaggaagagatagagatgtgagcatcagagccatgagacttcctggcatctctcaggaagtgattgtagagcagaaggacagaggatgagagacctaagtggaacctgttgcctaaagaaacatgacagacattaagctagtgatgagagcagagaattggttatttaaaacctacaatattttttataccttctcctgaattaacagtcttaataatttctgatggttggaataacattgtcccaataactctatcattgtctgggtgacctcatagcatacacttggcccattcaaaattaaattggttcttattttcagtaaatgtatgtatctcataaaattagaggaaataatatgcatatagtgtctggatctggaaaaagcagaacttttttttagctttttctgtctagcttaacacagcctttcaacattcttaagaagtacctttagggtattattctagttatatagaagaaaaaatagaggcatgatattggttattgaggagttctaaatagtagtatctccctattcagaatgcttagatcttttcaagtttagtttaacgttaaatcttctctaaaagatggtgctttatttcatcttcaaaacaaaatggaaaatgattgtatgaagtaagatgattgtatgaaattaataattaacattttaatatgtcattaaaagatactttttaaagatagatcattggtaagtcagctaatttaattcttgcagcctgaggttatagttgtgaatatgttttttttccccctccttcctaaatcgtttagtgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggcaagtatctttcacacttaaactttgattttgattttgatcattgttaactgtcctgtattttgaaatggatgttgtattggtatccaggtgtgtgtgtgtgtgtgtgttcacacatgtgcaatatttattccttcatttgataaatactgaatctactctgtaccagacctcatcataggtgctgggagatatagcagtgaataaaacacagaaaaatcccatcttctcatgaagctaggggaaagaaggatggtaaataagtaaacaaataaatagacttcaggaagtattaggaagaaacataagtcagactgaggggacggagagtaatgaaggcaaacagggtgatcagggattaggacctccgatgaggtagcatttgagcagagacctcaatgaaatgagggaataaagccgggtgggtacctgggagcttactattccagcagagagcagagtggggcagaggctttgtgtcaaagagcaagctttttgtggtgatcgaacactggatgagggagacaatggcaggagatggggcaagagaggcgtttggcaggggaagtggtagcaagatcatttaggcactgtagtttccagctttaaacttttgaaatgaaattttttggaaattaccatgaaagtttgcagagtttagctttcatctgaagtgaggaaattctgatgtacctgaaactaaactcaggaattaatggcttttccctctcttaataacttttcaagttgaagttgtcagcacactatgctatttctgttttctaatggcagcactggtcttatcaaactattctgtctctatccataggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaaggtacctcatacttccacatccataggacttggttgtaagaaacatttagcagaggggaagaatagggtgatgaaaatgctgatgtcaataaacttgttcaggttctagatttctttgactattatccatgaataggcctgggtaaaaagttgagattggcattgtttatctttttctttctttctttttttttttttttttgagacggagtctcgctctgtcaaccaggctagagtgcagtggcgtgatctcagctcactgcaagctctgccttccaggttcacaccattctcctgcctcagcctcccaagcagctgggactacaggcacccgcccccacgcccagctaattttttgtatttttaatagagacggggtttcaccatgttagccaggatggtctcgatctcctgacctcgtgatccgcctgcctcggcctcccaaagtactgggattacaggcgtgagccaccgcgcccagtcggcattgtttatcttttgactatcacaagagcagaaaaagttgcagctctgtgaactgtgtgtttgtatgggtgtctaagtttaagaacctgaaatgcttcgggtagttggctggcctctgtcagacatgaacaagaagatgagataggtagggtttatgtagttatgaatctaggctgagaaatgctatgactttctgtagcctattatctgtgactcattaggtgacattggcagcttcccaaatcctatgacagatagaaattggcttcagtggctcctgtaatctaaaaacatggtcatgcatgggatttttgtagattggtaattgaagatgtcactattgcaaaactgacttgtgtggcaatttccaagagaaagacctatcttaaagttttccatcagaggcagggcacggtggctcacgcctgtaattccagcactttgggaggcaaggcaggcggatcacgaggtcaggagatcgagaccatccttgctaacacggtgaaaccccgtctctactaaaaataaaaaaaatcagccaggtgtggtggtgggcgcctgtagtcccagctactcaggaggctgaggcaggagaatggcatgaacctgggaggcggagcttgcagggagctgagatcacgccactgcactccaacctgggtgacagagcgagactctgtctcaaaaaaaaaaaaaaaagtttgccatcagaaaacacagcttccagagcccaaacattttcctcatgacatcatttacaccagagacttgaggggtagatttaagtatccttagcctttgagttaaagactggtctcccttagtttctcttttaccttcatataattgatttttccctcttcatgttacttattttatgtagtatcattctgtagctgatgagatatcgacaagcccattgaggacaggtcggttcttatatacagtcatgtgttgcttagcaatggggatatattctgagaaattcatcattaggcatttttatctttgtgtgaacttcacagagtgtacttacacaaacctagatagaatatatctttatttacatagattttttcatatggaaagccaaatctctcaacactattactgaatattagtcatttcccctacctgatcagcaatgccattattaagtgccacacaccaggtttctacatgtgctccataataatcttttttttttttttttttttttgagacagtcttgctctgtcacccaggctggagtgcagtggcgctatttcggctcactgcaacctctgcctcccaggttcaagcgattctcctgccttggcctcccaaggagctgggactacaggcaccaccaccatgcccagataaatttttttttttttttaaatggagtctcggtctgtcacccaggctggagtgcaatggtgcaatctcggctcaccgcaacctccgcctcccgggttcaagcgattctcctgcctcagcttcctgagtagctgggattacaggtgcccgccaccacacccagctaatttttttctatcttttaatttatttatgtatttatattttttgagacagagtcttgctctgtcgcccaggctggagtgcagtggcatgatctctcctcactgcaagctccacctcccaggttcacgccattctcctgcctcagcctccccagtagctgggactacaggcgcctgccaccatgcccggctaattttttttatttttagtagagacggggtttcaccatgttagcctggatggtctcgatctcctgacctcgtgatccgcctgcctcggcctcccaaagtgttgggattacaggcgtgagccaccgcgcccagtcccagctaatttttataattttagtagagacaggatttcaccatgttggccaggctggtctggaactcctgacctcaggtgatccacctgcctcggcctcccaaagtgctgggattacaggcgtgagccaccatgccccacccataataatcttaagggaccatcatcatgtatgcaggccgccatgtctttatgtgctgcatgactatagctcatgcacatgatgacgggaccatgtccagggtgactcctgggggtgggagaattgcatctatggttaccacctctactttctttttacatgggaaaatactaagttattccttcagtggagaaattggtaaaaggaatgaaatttacttttttcttcccactaatgaaatttttaatgatgaagttaatatttttgaaatttgggggcttgtacctgtaatgtaaaaagggcttcttttctgttttctgaagtttttgttttgttttgtttcattacgtttgaataaaaaacctatgggttttatttcacagaaggtggaggaaagttacaccattctttgccaaaggctggctggatcagccctcacagacaagcactcaggtatgtaaaagttatgagttccagactctagactaatcatcctacactgaatgaaatgacttatcatactttgaagtgaaaaccttctgagattccatttctcttctgtctttaaagaactgcctgtttctaaacatcagatatcaagcggaagctcatgcctgctgactctactcttctctaagaggaactgcagttgtcagttcccataccatcccctcttctctctcttttcaccttttcaaagcagaaggcagagcagtgggaagcctggtaaatcacagattcggtgtgaggcttactggtactgctgtgactccctagtgtggaggatttggccttattggatgttggtgcacttgcctctgctgacagtgtggctggtgtctcccctgactgcagatggatttgtgttccctgcagcagtttatactcatctgcttacatactgattcagaaacaaagattgaaccacgcccacagatgtcatgggtattctttgcaatgttagtatattctttttcttaatatcatttccatgtatctttattcttctcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 2 - DNA, 153525 bp, Homo sapiens
  source 1..153525: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggttggtatgaattcctccttcgttcggcctcccggaatcgggcccgacctagcaggggagtcggtgattgcagattgcctttggccagcgaagttgacaggcagaggaaagagggttgtttcggagctgtgcagttagcctggggttgctgccgagttatccagttgattggcttttggaaatgtaatttttccggagagaaacttcccttccgattctcagagaagggggaggcaaaaccatgattgtggttttccgcctgtagtgtgcattaggattgtgtactcgtctggaaatcagaggagaaggtcattttaggtgaaggtcggtgcctgaagtcggctcggtattggtgtattatttatcagctttagccgtgtcctgcagtagattctcaagacaattacattttaggaatttctacctgtgaacttaatgttgagcctactgcatggtgatctgggaacttgatctctttcagatgttgacctgcacggtgtttaattattatctaataactttccagaatgttgacattaccagtaaatcacaggttcttgctggaagcaatgtccaggagctgaagaaatgagggtaaatcatggggtttgcttttaattcttgtatttaaatatttcgtcttccagaaacacttggcgtttaagagatataagccgtaagcatagtgtaagcgcgcagctgaatttgttgagttctgtgtctgtcctttatagcacctaccagtgttgcatggtggtgggtggcgaattgagctagaccatgtgtggttgaagtgcagtttgcttatcctaagttactcttgtttatagggtaagggataaaaagcatattgattccttgaccacatttcattctcaatttaattatgacactgcatgctagtcccaaatttgtcagcttgctttatttttaagtcagtcttcgaattattacaccgtgaaaaaatagatcaagtaactgaattagagggccaaagctctttgatgaaaagtgcaacaatagtgcttctgcacaaagtagtcttaatttcctaataagagttttacccaattgtaagactcatttgttgattttaaaagggccaaattccattatcataccataacagctactccagaaacagaacttcctcttcctgttgatgctttccagcatcacatgaatgttcacttaaaagagtctgttaaatatttaaagtatttatatttactctttgtgtatttttcaaagtgggttttcattttcaatgaaataatttttaacttttccaagaatacacttaagataagtattgacaatgcttatcttactttcttctggttatccccatttttttcctttcagggtgttttgcttctgagaaatcacttttacgggtgtggggataattgttttcctgcttcattcaattctcgctctttctgttgagcctgtaaacaaaagtcttgctaggaactaatgtaatgttggttttcattgcgatgctgaggtgtttaatttatggaaacagaacggactcattccacacacaagtgagtgaaaagccctcaagtaatggtttttcttcagcattgcttctcagggattttccttgtcttctcgttatcttggaaatagaatcttggaatttgtatcctctttataacgtagatggcatataaacattcaataaatatgaaattactgaaagcctgtttcttttctttttcttttttttttttttttttggccaggcactgtgcaggcacaagagattacaaaatgaatattgtaagattaatctgcaaattggtttgggcattaatgttttttgaactggttcaggtgctgctgcctaattttacattttttttttttaaagaaaagaccttggaaagccaattaataagcactgctgagacctgtttcgtaggatttttttttactagggtctttttttattaagaattattcttatttgaccacatttaaatatattttgtaaatataaagcatccatttgctgttaagagagtagttgttcctaatatgaatatatgttggggtgaaatctggaggtactggtttagtattatttctctgccaaggtgtcttaacaaagttacgagtatataatagtttctagctttctgtcagccctacctcatccttttttcgtagtgtctaactcttactgtaggtatattttgctgactctagaactgttggaaaattaacagcaccagtgtagctttttagatagagatcctttcaagtttgaagtgctgtatgtggtatggctttgtttcgtagagtgtgcagaaccaccaggccagctgtgtgagttagagttctttcattgtggtgcttctgactacagagtctgtctgtcctcagttgaaatcagactagctggttttgggcgttgttctgttttgcagtttgtggcaggcgacacatggctgaacaagataagggttttattcttgtgttagggacgtgctggggctgggatggaattcagctatgtttaggctctgattggtcactttggatactcagaactctgttacatcctgttattattttgcagttaaatcaacacattaacttgctctcttctctttcccttcatcttttactccccagtccgcaccccttaaaacctaaaactcaaactttttaaaagactttaaactcaaactatgttcatggtagctattacttctatgtagtatatccaaacagctttaaaaaaaatggtaagcaatttatgagccctggagtctgtagttttcatcgtttagaatgagcacttgacaagtgtagaaatgtctgattgctgctttttagtctgcattgattgctgcattcagtcttaaaatacatcctaatcgtttccaatcctcctacatgtctttcttgtatccctgagaatttaggggtcctatagcaattggaatttcttctgagaggtagacaggagagaatgcccttttagtagactcagtaaatgatttcaggccagtgtctataacattgaattttcagggacagtacaggtaggaaagttatagggttcttccttgaaataaatggacttttgttttggctagggcttatgaattttgtagtttttgatttatagataaagacaggtttttgatacaatttttttaaagcactgaattcagctttgagctgtttaacttaagcagatttttaaagtgagtgtggaaacctgtgactttatatgcctgtacccagtaattaatgatacttttcattagtgatactttttctgtcaaaattgctgtataatggttttgattaaaaaaaaaagagctactcatgtttatatgttattttcaacgttgcatgagtcatctctcggcaaggtgaaattatttgtaaccttttcttgtaaagtcagccagtccataaatacaaaattgaaatgggggccaaagatcacagtgttagttttgtattcagttttatctttgcctttttagttcagtataaaatcttgagtcataaaggtatgcaatagtacattcacttgtacagttttacatgagtcaacatgcagaatctaaagtaactttttttgaaagtacagtgttgtagtcttcctgattaatggtacatttatatgatgttcatattcagtaaggtgacaagagaagctttatttgaaatcattacaaaaatatgttaaccttggaataccacttaacacattggtggtttccggttgttaacatgtatataccatcgagttaacatgtaggtttttttcttttttgagtcttgctctgtcacccacggtggagtgcagtggcgtgatcccctcactgcaacctccgcctcccaggttcaagcggttctcctgcctcagcctcctgagtagctgggattacaggcacccaccaccacgcctggctaatttttgtatttttagtagagacggggtttcaccatattggccaggctggtcttgaactcctgaccttaggtgatccacccgtctcggcctcccaaagtgccgggattacaggcttgagccaccgagcccagtggttttttttgttgttgctgttgttgttttttaactaagtttgagttttcagtttaaaaaatgaaatttgaggcaaacattcatggaatccataaatggtgaattttacatatgtttctgtggagcattgcgattccagggaaaacagttggaaaatatttcattgtacatatgtggttgcctcttctaaatgtcatccagtggtgggtatgaattgcttcccaaactgatacgggtcacagaaacagcaagataacatactggttcccagaggtaattgaagggactcttttgcatcatggttgtctgacattattagaaatgtttcttatatacttgcttgtttcctagaaattgaccatgacacattttcaagaatagtagcttaacttcttttggtcttttctgttaaaacttggttttgatgatgttcctgagctttatttgaagacatgctcctttcccttataataattacaggttttcaaaatagtgccatgtgagttaaaatttttaaatcaacaaaattatatttttgccttcttttgagtaaaataccatcatgtaggtaatgatatcctgtggtagtataattctttaacatttacaatattttcagttcagtacagggcagatcatgcttctgtcatttacactttaagctaattcatacagtttaagtcaagattttaagtcaagattataaaactagaaagggcagacccaagattttaacctagattttctggctctcaagtcccccattgttttttttcattttaaattattgtctttctttgtactgtatttttctgtgctattttcctttagtaactctccagcttgatgaagtcagttggatttttctcttacagcatagtttctagtaccttacccattctaattttaaatatctcttgaggataaagcttttgtcacttcctcaggagactgaagcacagtctgatagatcttgctgtcaggaagtttttcctgatctttacgtctaacttttcttttaagttgtcctgttacttgtatgtacttgctgtaccaggctaaataatgctctcctcccattttatgtttgtatgattctaaatgtttcagacggttattcattatcctttccggtccccttcccttactctttgcttagccaagctgtatgctttctgttgatccattgtctaaaaatcagcttatcttaatatttcattagctttttctcagttgctctcctactgcaaaaatatgggtaaagagattctcaaggtcattttgattcacttttattttagatagtctttaggatggatatgagatatgtcacagtcaaatgaaacaaatttatacaaacagcatgattaccaaatcaactaattaagcaattactcatgttctaaaaggcttttttacaaagcgattctttcaaatatgagtaccctcaatgtaacaaatgttatcaattctatgacaaaagggtagggtatagaaataatgttagccacctttgatggaaaatcatcttgttgcaatatgatgaaatacatcaggaagttgtttcttattttttccagtggtttttcagttcgttatcttaaattgtaggtcaaaacattcctcgatgtttggtttatttttaccttattgttttgtctcctcttatttccacatgttagtgaaataacaatgcttagcagtattttttttttcagtaaaatggatattgtgaaaattgaaatattttactttcttgctgttgtatttacaagaattgttaatgacaagacagtgtaacagaaaaagtgcatatttagattattataaaatctgtaagactgtagaccttttgaatactttattagcatattttctttagtactattttagtttcaaattattgagatagatgtccttgttttgtattttgctaatattaatattttgtattttggtaatactaaaatttgcaaacatgccaaatttagagcattttactttttcaacttagaatatctggaatcatcaagatagtcatatagggaagaccgctataagacagcttctaactccaatagaagcctatgaagctagtgcctggtcagaggctgtgcctaaattgcatgagtatatagtgtcgacttttagtaaaagaaaaaatacactaactttacctcttgaattagcatgcaccaatgcagtttagattcataccgaaacaggatcttttactaattcaaatgctgagtcctggtttttgagatcacagtcacatgacaggcctgggtggcttctcagtgtctagagacaagcaaatctactggccaatgaaaagtaggtttcctgtcttggactgcaagtaacaattcatgcagaaattggaactatataagagagcctggttttagttaatgctttcaattagctgcttgtcacactgctttttcttttggtgttatataacacattagagtcatttaaaggtacactctgatactacagtttttgtcaaatattacatataaatgttgattttacattcatatactcaaaagatcaaagaggactttgtagatcttttatggattcaaaaaaatgtagattattttgttgtagaaaaactggccaggcgcggtggctcatgcctgtaaatcccagcactttggaaggctgaggtgggcggatcacttgaggtcaagagttcaagactagcctggtcagcatggtgaaaccctgtctctattaaaaatacaaaaatgagccggaccaggtggcacatgcctgtaatcccagctactcgggaggctaagacaggagaatcacttgaacccgggaggcggaggttgcagttagccaagattgcaccactgcactcctacctggatgacagagcaagactccgtctcaaaaaaaaaaaaaaaaaaaaaaaaaaaaactggagacttcatcagcctctgaaggaatgatacctgaaattgatcttgtaatgcagaaagtggctatatgttatccagaagagtaacagataccccaaatacacttgctaacacaagaaatcctgtgaaggtgcttagacatacccttccatagattttagatgggttatctgcctatgttccagacacaagccgatatgttgtggtttgcccagtacagtctctgtggtttactgagaggaagtggttcttgtgggtgaaggtctgatcttttcagagattgttggtggcatatgcactgtcagcctatttcctgttttattggctgtttagcaagaccttcttagggcaagtgctgctgaagaggtatttaaatattttgtattggcaggatagatggttataatgatgtattattatatcactacttctcaggtgatatgagagttaaatgaatgtttgtgaagtgctttgagatcttaggatgaaaagtacagacatgttcttagtcatttgcaggttactgctatgttcagatattgctctcttgaagttaaaacttgttcatgtagtaaagtgttactctattaaacttgatttctgtaaccattcaagtgttgttttatcaccacaagagtcatgattagaatttttcccctttttttcctttctttcaatgctcctttatgattttaccctagaagagtttccttaatagattccttgctctagtactggttaaggcatatttaccaaacttaacacctagcaagcttgtccaacctgccttattttgctgttgttcttctgttttgttttgttttaggctttcagcagcctgaagccatggtttttagtttctgtctctagtgataaaacggaaagagggatgaggaaggggctttactggcccatccagaaacagaaactaagaacccatgactgtattctctcccttgaacaactgtaactagagcaaacctctttgccaatttaactggcatactaaaataatgaaattgtgagaatttcctttgagattagtaactgtaccatccatatacaaaacactatattgctttgctgaaacctgaaagtgagcaaactgatagaaatgcatataacaggccgggcgtagtggctcacgcctgtaatcccagcactttgggagaccgaggtgggcggttcaggaggtcaggagatcaagaccattctggctaacacggtgaaaccccgtctctgctaaaaatagaaaaaattagccgagtgtggtggcgggtgcctgtagtcccagctgctggggaggctgaggcaggagaatggcatgaacccaggaggtggagcttgcagtgagccgagatcgcgccactgcactccagcctgggcacagagcgagactccgtctcaaaaaaaaaaaaaaaaaaaacgaaatggcgtatgtcatactcctaaatatatatatatatacagtatttagccttggacgttaaaaaaattaacaatgaatgggggaaggctttatttaaagctaaattgttagctaatacgtgagttcttcaagggtataagaatagttcttattcatttttaagtaattatcggtagccttattatatttttattttttaatactgaaaagcagaaggaagaaaaataaatggcccaaatgatccaactacccagatgttgctgctcaggttaaacgcacacacgcatacacacacagaaaattcaaatcatataaaatggtataaaaaaaagtattcctacacacctgttagttttcataccttctcctcataggtaacaatagttaatttttttggtttatcttctgaaacatttaaaaatatataccagcctataattttattttttgcacctactccataataagtgtatctgtcttcttttgctaggttatgctgctgtagcaacactatcaaatttcagtggcttacaacactgcttttcttcttgcttatgctacaccttgtcagctgtggattgactgcagcattgcttcacgtttcttattttggaaccctggctcaaggagcatcccctgtctgggctgtgccattattgtggatgagggagagagcaagaaaacagatgcagacatacaatggctcttaaagctttcactcagtcatgttgtatgtcacatcagctcacatgtcagtggccaaagcaagtcatatggtcagagctcactgtcagtggggtaaggatgtatagtccttccacaggtggcattgcaagttgcatgataacagataaggctgtataatcctcttaaggaaagtggaggttaaataatttggaacaataaataatatagtctacatcaacaagttcagtaaatgcttgttaaatgggttatttggagtctatgaaagtttctttttttttagtgggaaattcaaacataaacagaagtacagagaatggtatgatgaacctcccttgttccctttattactccagcagttaatgtacggacaatcttggtttatctgttttctttccccccttctcactagattattttgaagcagtttttggatatcataatttcacttacaagtatttcactaagtatttttaagagataaagtctgaacgtgtgacttctcatagtaaattattactgtctgatagggtgaggtaatagtactatatagactgacaggtgtcaagcagcagagcacgttcatagagcgtatctagaatttgacagcctgaacttgttttgatttcattttgagtatttctggaggaggcttacaacagaatgccatctacttttccagcctctccctttctttctttctttccttccttccttccttccttccttccttccttccttccttccttccttcctttctttctttctttctttctctttctttttctttctttctttctctctgtctctctctgtttctctctctctctctctctctgtctgtgtgtgtgtgtgtgtgtgtgtgtgtgtgtgtgtgtagcagaagcaggtaattaacctctggaaaaaataacattgcaacagatttgatttgcagaggtttcatttctcactgagcctctgttggaatgatgccagttgaaaggaatcccagctcttaatggctccaagtcttctgggagctctcagtgatgttattttctttggagaagaacatcagaatcatttataaaaatcctgtgttcacccatgccatttgctctgtggagaaaggatctatcatatctttaagatgatctctaagatgatataaaagtaaagaaattcatctatctaattttagtttagaaatcattaatgccaatttcagctgctcaggttagtttgtcttgaaggcctgaaagcctccattttgattcaagatgtcgtagattttatgagcattcagtataaccagtaagtttgtcatttccatggttgtagggaatatgagacattctgttatggatctaggattaccgtttcacaggacattctttttttggggggattgttaggtaataaacagtgggacacaaaataaacagatataatctcttcagtttgtagattttcaggtgacaatgaggtggcagaagaggatttgtgcagattaggaaataaataattattgtatataacatgatggaaatattttagtatagtaccactatcaaattaattttgtttccttaactagcttctttcattgtgtacagagacacttatattaaagtagtctttatagatatccagttagctttagttttttctaattacattatattgctagtctcatttcagagtccatgtaggaactacagtagaaaagtagctatcattggcttgtaaataaaattacttaattttgagtttttcttgggaaggaaaaaccagttttacagaattagtggagttgattctggttttggttacttgtgacaatatagtctatttaaaatataaataaataaaaatttgcccaagaagaataagtttgacttgccatgattcatactgtttttctgttgttgtatcacaattgagaacattagtttcagaggtaatagtttgtcagtatgggtcgagtagctctaatccaaaaatccaaaatcagaaatgcttcaaaatctgaaactttttgggtgccatgtgccacaggtggaaaattctacacgtaagtacataatacaaactttgtttcatgcacaaaattatttacagtagtgtataaaattaccgttaggcgggggccaggcatggtggctcaagcctgtaatcccagcactttgggaagtcgaggcaggcggatcacctgaggttgggagtttgagaccagcctgaacaacatggagaaaccccatctctactaaaaatacaaaattagctgggcatggtggcacatgcctgtaattccagctactcgggaggctgaggcaggagaatcgcttgaaccagggaggtggaggttcaagcgagccaagatcatgccactgcactccagcctggaaaacaagagcaaaacaccgtctcaaaaaaaataataataaaaaattaccttcaggctgtgcatatagagtgtacgtgaaacattaatgaattctgtgtttagacttgggtcccattcccaagatatcttactatgtatatgtaaatgttccaaaacacaaaaaaattcaaaatgaaacacttctggccccaagcattttgggtaagggatacccaatgtgtacctttgttaggataatatacttgtaccttggttgtattttagttgcaattgttagttgcacaatttgggggaatgtttgaggtctctatagtagttactgtatttaccaggaagccctgcatgattagaattcttgagacagtgtataaagttaaattgggtgtgttgcctggatgtgaacagtaaaaaaggagaagcttctcaccatacaattatagcttaaaaggaaccaggtacaattctgtttccaaaaatagaaagtaagtcaaatattatatggatatgtaatagtaattatattaattttgactccctggccgactttttttttgaagctatcattttttgtcagagataaaaagtagcttttaaaggaaaagatatctcagcccttaattatgtgtgtgtgtatgtgtgtgtatgtatttatttatatattttagcccttgtaagagaggagcagtggaagggaactgaaggagcatgatatagagaaaagagcctgggttttggtgtgttgcatttgttctgttactagctgggagaccttgggcaaatttacctctctgatcagcagtttaattttttcatctgtaaaaatgggaagaatacctactttgcagaattgtcgtgacgattaaatgagagtgtgtgtgagtacctagcacatcgtaagagagagctcagtaagttatagtagctgttattgtttaaacttcaggaattagctaggttttgctagaactttcatctgtgcttgtaagatctttttgaatccatatgtatttttagcagctgtggctaagatagtttttttcccttgctgtgataatattccttatcttttatatttcaggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagttctgtatttattaacatcagtttgtttatttattcagtaaatattgaatgcctgttctgtgtaggtcattgtcttggcagttattttgagctcttgctacctgctgaattatatcttaaaatgaagaaatttacatgatagagtgatatttattcatctgtgctgaagattaaagtgagaagtatgtggcaggcgcggtggctcacgcttgtaatcccagcactttgggaggccgaggtgggcggatcatgaggtcaggagatcgagaccatcctggctaacacggtgaaaccccatttctactaaaaatacgaaaaattagccgagtatggtggtgggcacctgtagtcccagctgctggggaggctgaggcaggagaatggcttgaacctgggaggcagtgcttgcagtgagctgagatcacgccactgcactccagcctgggtgacagagcaagactccgtctcaaaaaaaaaaaaaaagtgagaagtatgtgtatttgggggaagttgtagaatgaaataataatgattaaattgatcttatttccaaattttaaaaatgtggttactttctatcacatactgtctttttatgttttcctttttattttatttttcagtttagttatatttcagtgaactatttagaccaaaatggaaaagacattggtgtaagttggaatctaagaagttttagatgttcattgcttttgaacagaggaagtaacattttatggattgggcattgttttagtcactacttgaaggagaacctcttactcattatcagtctcttggaaatagcaactgattaagcctatatatactttgtgcatccagtgaaaatgtgataaatatgatgatcttttggtcagagaaggattctggaaactgcagtagtttgattagtaagacagtgtttaaatcatgattacttgttgctctaatattttagactttgaaagatgacaagatgtgatgtaggtgacaaagagcatttttaaaaatgggtgaaattggccgggtgcggtgactcacgcctataatcccagcactttgggaggctgaggcgggcggatcacaaggtcaggaaatcgagaccattctggctaacacggtgaaaccccgtctctactaaaaatacaaaaaaaattacctgggtgtggtagcaggcgcctgtagtcccagctactcgggagactgaggagaatggcatgaacccgggaggcggagcttgcagtgagccgagatcaccctactgcagcctgggcaacagagcaagactccgtctcaaaaaaaaaaaaaaaaaaaaaaaggtgaaatttaggcctatcaagatacttgggatgtaggaaaggaatatatatatatatatatatatatatatatatatatatatatatatattttttttttttttttttttttttttgagacaaagtctcgctctgttgcccaggctggaggctggagtgcagtggcatggtcttggctcacttgaacctccacctccctggttcaagaaattctcctgcctcagcctcctgattagctgggattataggcacccgccaccacgcccgtctaatttttgtatttttagtagagacggggtttcaccatgttggccaggctggtctcgaactcctgacctcagatgatctgcccgcctcggcctcccaaaatactgggattccaggcatgagccactgcgcccggccggatgttacatttattgagtacatattaagtactgctcactgttttaggtacttcctgtgcattgtcttttttaacctttcaactaagctaaatactgttgtccctgttttaaaactgggaaaaatgagcctctgagaggttcactaatacccaagctgacatagtttctaaacagaagacttgggattattactccgatgctcgcttttttgaaactactggtcacagtcgtttgtggttattggctcatctagatcaatcaattggatgaaacccagaaaatagattttgtcttcaacaataccattaaagagttgccttcacattaaaatttaataactacatcttatcctttgtactcttaatcacctgttttccctattttcttttccagatttctgacatgagggattttgtctcatttgctctaaagagtgaacctaaacattgtgtttaggtttgttattagttgctttaaatatatacacatctgtaaacattgaacttttttgatgcctcatctgtgttgcttatagatcattttccatcataattattttaaagtccttttaagaagtttaaggcctatctcatatatgtaatatattaatagtagataatcaggcctttggaagcataaatgatgtaagtaagttgggttgcagttttttcttatcaagaatctgcgtgtgtttaagtggcagtggagataatatttttatttgcgttgttatagtgttatctttatcatttagtttatattttctgccatttaaagataaaaaggttttatcttttatagctatagagtcatcttctgagccttaaaacacttgtgttttttttcttttcgccgtgtgggtggggaaaggggtgtgtggcaatggccctgtgctttgcctctgcctgagttacaggcgtgctttgtttgcctggctggggtttgtgtctcccatgctcaggagggtggaaccagtttcccagggcctgggccctacctattgtcattctccccataaggggatctgttacgtgtacttgtgggaccacacagtgctctgggcagataagcctcttcctgcctatatcagaaccaacatagcccacacacatctgggaaagcatgccagggtcagcaccccaggcgccctgtactcccagcccattccccttcttcttcccactcacctggaatccctgacccaaggctctacctattggttctaatattctggtggacagaatctaagagtccagcaagctcagaatctcaggacctcctcatccctttaggaaccatcaattaatctcatgatttcaggttgaaccactggagtcaatttcagaagttttggtctatctcagaaccttcagatcacactcaaaagcttggggacagcctcagaaccttgggacacatctcagcatacagggtcatcaatcttagaacttgaggtctgtctcagaaccttcatgcgaaactcagaatcttgggaagtcccaggaccttgtgcccggtattataccattggatcaattatcacagtcgcagaatcttgaggtccatcttggaatggtgcagtcagcctgaaccgtgggatcaagttcagggacatgagaacaatctcagaaacttctggccagtcctaggtctgaaaaccttcaaaacagcaacagactcttgcggtccatctcaaaacttgagattgtggtctaaaagggaccctcaagactatccatccagtcccttcctggaatacaagtcacctccacagcctccctgatctcgctgtctagtctttgctatgagccctcctcgatagggatacctggcccctacccactgcctgccttgcttctggatggctccagctactaaatgatgtctccaaaatgtgagaatctgaaatctgtctcctttttcccacatcagccctctgagacctctgcagagatttcaaggcaagacccatatgctcagggtaagctttgtcccagactgcccacactgggttcctcccctgacttccagatctccacccgcccttctgaacactgttatctgcaacacagttacctgtttatgcatttcaattttgagcctataggatatctcatactgcaaaggaaaagcccattgggaatgtctggggtggaggtggatgcccaaccctgtgctgggtgatgctgggggaatcacagcaggatacagagccccagaaccccatggggtcccagaggaggagcccagaggaggaagcgggaccatacctggaggggctgcctctgatctcctcagagactaggggtgcagtgggaggagaagataggagatgcctagagaccctggccccacagagatgcctgtgagaagagggaagattcctgtttcactattctcaagagctgggagaggcttctgagagagaacctgtaatcccagtcggcccaattacagataggaaagataaggctcaaagagggctcagtcctaccccagagtggttgggtgagtcaggactaacaagtcctctttcccattcccctgacatcataactctccccaccatgatgttatgttgctgcatttcagtcttctcactggccatcttctcacattccagcttgacactaactaggaaggagagagaccatgggggtcccacacaccccatatgagccaaagtgaaaaacattgttacttttaatctcatttcttctttgtaaatgattttttgtctctgaaattctgtgacatgaatcagtttagtcactttttatcttattaaatggagagaaaaattgcttaagagatatttaggtgtgttgttttttaaccctttttggttgtaaattgttttctttctttgttttagtaaccccagaaaatctagaagaaaatctagaagagaggtaggcagatcattggtttaaaaaaagaagcccaccaactaaatcttttattgagtaaagtattgtttctaggtagagaaagattagagaattgtattgagaattttactaggtttgggatttacaaagaggctaacatgcaaaaggcagtgctcttcgaaggagtcgtatagatgtggagactttatagcccttagggagatctacagacatccgctatgctgagttctgggaagctgctttttcccatgcttgcagcctccccgtggggtaaaggtctgttagttttgcataaatatttaccatatctcattttagctagcattgcttcctcacactgttagcactaaggagaactttgcttatccagcttgaaaaatttactgtgatcgatatgactaatctggaggatgttctgtcatctttgagcattgatgaagttaaaaagtcagattggcaaaaataatgagggggaaagcaaccggttcacagttgacaaacatttgcccatgcttgttttcccatatttatttttttaaacgagaaggttattacacaagcagcatttcagtcttgtcacacccaataaattattgttgcttttatatgtttatttgtatactagtcgtttacatttgcatttactatacttttacaactgtttccttattttgtaaccatgaacaccagcttctacatgtaaagcctcattctaggtactttatatacatcatatttaatagatataataattgtacaaggcaaatgttattcccattttacagatgagaaaaaaacttagattcaaagacattgattgactagatcagtatttcccagctataaatttttttggaaccaggttttaaattcaagtcttttagcggggcacagtacctgtagtcctagttacttaggaggctgaggtgggaggattgcttgagcccaggagctccaggctgcagtgagctatgattgtgtcagtctacttcagcatgggctacagagtgagactctgtctctttaaaaataaaaaataaaaaaacccagatctttttgactcttgattcattacatttgctactgtacccaattttatgttactccaaatgaaaatattcagccaaagaaggttatttaatctattttaagataaattacaggagtaatttctaagttgtgttacagggaatatccaggacactttaataggagtgtatttttttgactcatgagccctacaacattcaggcattcaaggccaaaggtagaatgtaaaatgatattaaaaggcaaccttcagactttgagtttattattttaaaaaagatccagcttattatggaaaaatggcctaatccattttattagtcaaaaacaatccaacatttgcaatttcatgtgattcaggctaggagcaatctatcagtatgactgcgtcttaaatcttgtcaatatttgataggattctactttaaaatttttgtgtttttgtgtctcttaccttctacttctccttcactccatgtcttttttaaaattttttatgtttttgagaccgagtcttgctctgtctcccaggctggagtgccgtggcatgatcttggctcactgcaatctctgcctcctgggttcaagcgattcttgtggctgagccacccaggtggctaggattacaggtgtgcgccaccacacctggctaatttttttttaagtagagatggggtttcaccatgtttgcccagctagtcttgaactcttggcctcaagtgatctgcctgcctcagcctcccaaaagagctaggattacaggcctgagccactgcgcccagcctccccttatctttttgcatgtacactttgtctttattgtcatcactaagcttttaatctttcctttgttaccccatctaggtcctctgctctccctcaaccttttacttatttctggttgagcccttttgtcattccctgcaattttctgaccatgtagtagatacccagtaggcttcctggattacttggtttttctgtattttgctaaaaagttactccaaagatgataccttctatttggacctttcccaccctttatatacctatctaggaggtagtaacccaaccattaatctctccatgcaaaatacatgtattgactaaaaattatgtgctaggtactgtaatgtttcctacccattattttacttaattctcacaattactctgtgaggtattcacaggtgaagaaagagaaagtttaagtagcatgcctagtgagtggtaaaacttggattttagtatgaatctgtctgacttcccaacctgcactgtttttttttttgttttgttttgttttttttgagacagtcaccctctgttgcccaggctggagtgcagtggcgtgatctcagctcactgcaacctcagcctcctgagtagctgggactgcaggcatgtgccaccgtgcccttctaatttttgtatttttagtagagacggggtttcaccatgttggccgtggctggttttgaattcctgacctcaagtgatccgcctgcctcaacctcccaaagtactgggattacaggtgtgagccaccatgcctggccccagcctgcatgcactcttaaacactatcctatactgccagatatggtcagagttgaatcagatactgtttctgccttttaggaacttcgagtctaatagaggaagatagagaactaagtgcacagggcacagtggagactgaaaggagaaaaatcattactttttggacagatcacagacagcttcatagaggagatgaatatatttgctgaatcctggaatgtgggatgtagttactggacaggtaagggatagaggaacaattcaggtaaaagaaacaatcaggtttttttgagacagagtctcactccatcacccaggctggattgcagtggcatgatcttgcctcattgcaacctccacctcctgggttcaagggattcttgtgcctcggcctcccaaaatactggaattacaagcacgtgccaccgcagctggctaatttctgtatttttagtagagacaaggttttgctgtgttggccaggctgtccttgaactcctgacctcaagtgatccgcccacctcagcctcccaaagtgctgggattacaggcgtaagccaccgtgccaccaaaataaggaatattaataaggacatagaggtgaaatagctcacattttcaggaactgcatatagttcagcatggctagagcatggaggttgatgatggatgggcacagcagttggtaaagttggagtgataggtggtaccagattatggaaggccttttaagtcattctaaggagtttggattttaacctctggattgtagggagccactgaaggccttcagtcagagaggcagtaagcgttatgttataaaagattctttcggtggtagcgtgaagaaaggattagtcttgagcaacagtttcaggggcagagaaaccaatagtgagacatttttcagtaatccatatgaaaaatgatactaataaattcctaaactgaagttgtaacatatacttaaaagcgaagagacaaagttattaagaagatactaagaataccagcagggtgaaaggtgtgtggtcaaagtgtggggctttctgggttgtgtccttgggtaggggttggtaatacttagcaagatagggaatgtaaaagggagaaggcagggttttgttttgttatttttgtttggctgactgataagatggaagatggagaagagaacagacatagtaagggatagatttagtttaagttactaaatctttagtttaagtattcactatctgttgtatgatagattatcccaaaacaataaacttgcactatccactatggtaaccacaagacaaatgtggctatttacatttaaattaattgaaattaaataaaattgaaaattcagttcctcagtgacactagccacatttcaaatattcactagccacatgaagccagtggctacagtactgttggttgatcatagaacgttttaaattattgcaaaaagctcttttggacagtgctgccaaacatttatcaacgcatagtttactaagatcagaaatcggtgagcaactttgctgggtggttctgcttcaaggtttctcatgaggttgcagtccaggtgtctgcaactagaagcaagggcttcaggaatctgaaggctcaactgcacctggtgggtccatttccaaggtgacttactcatgctggtcaagtgagtgctgattgttggtaggaagccctagctcctctgttggtaggtggacttctctgtggggatgtgtgaggcagctggctttgccctgagtgagtgattttagccagagagggaggtagaagccattataacttttgtgagctgacctcaaaagtcacactacatcatttctataatctgttggttacacaggtcagcactattcactgtgggaagaaactatacaagggcatgaataccaagagtcaatggggcccattttgtttttttgagataggatctcactgtgttgctcaggctggggtgcagtggtgtgatcatggctcactgcagcctgaatctcccagcctaaagcagtctctcatctcagcctcccaagtagctgggactacaggcatgccaccatgctcagctaattgtattttatttttatttatttatttatttttggtagagatagggttttgccatgttgcctaggctggcctcaaattcctcggcacaagtgatctgcccaccttggcctcccaaagtgctgggattacaggcataagccaaagtgcccagcctattggtggtcattttggaggcttcccaccacaaatacttacggaatatctgggtacaaatatctagtggacaactaaatgtataggaatgagttcttagctagtgctattatatttgtgatggtagttgaagaaacttgaataggtgtagatcaacaaggatgagattgaaccagaaagacagttaatatagtatcttgggtcacatgtttggggaggacagaagtactttcaaaggctggaggaacagctacaggggagtagtagtagaacaggcaggggagtacattataaaggaaacttgaagggatgaaagttgaaagtagaatgtaattaacattgttcagtagttaaataagagtaaaacttaacagagtcattctttcaaaaaatatttcttgaatacctgtgtggggaaccagagaaagattggtagataaataagaccaagtctctaataacacgtaatactatctgaggagacaagtttgggaaggtttcttggaggaaggtaatattttaaggtagagactctttaaagggtaaggaggtgagttgggtattttaggggtgtggtggtagagatatggatactaaagtggacatttcaggctatgttagatgtggaacactgctaggatatgaagttttgtgatgagggaaagtggtgagaaaagaggctggaaggccaattagagtagtcttgaatacatgcatgttaaggaacttgcctttatcctgctgactgtttcccatacttaaatttggatactactttagtgatttgccataggcttataacccctaaactgtaagttactaaacatttttctttaatattactctttattattttatttatttattttgagacaaggtctcactctgtcactcaggctggagtgcagtgatgcggtcatggctcgctgcagccttgacctcccaggctctagtgatcctcccacctcagcctcccaagtagctgggaccataagtgcataccaccacattggataatttttgtattttttgtagagatgaggtttcaccatgttgccccaggctggtcttgaactcctaggctcaagcgatccgcctacctcggcttcccaaagtgctgggaattcaggcgtgagccaccatgcctggccagtaatattactttttaaacttagaaaccatttccagagggaacttcattgtattgttataaatagaaaaccagtattgtttgctacatataaaagagaatagaaaaaatatgaatgattattacgttaaaaaaattaaaagtggaatgtagcaatgcatcctttgatatagaaaaatgcccacttggaaataagttcctcagtgagaatactatttttggtcagttagcaataaaagggcctttgcttgaatagtgtttggtttctacctaagatgagattttaaggtcattaagacaattccatttttaaattttgatgttaataagcaccaagaatcacaactctcaagtctgcgtacttggaaagatcataatacagttaatggtcaactttgtccaactttattgttaattcaagcactaataaaaattaagcccttttgttccaagaagccatctaaagtagtttatagcaggggtccccaacccctgggccagggctgcacagcaggaggtgagctgccagggcgaaagagcattactgcctgagctccacctcctgtcagattgctggggacgcattagattctcataggagtgcgaaccctgttgtgaactgcacatgtgagggatctaggctgcacactccttaagagaatctaatgcccgatgatctgaggtggaacagtttcatactgaaaccgtacgtacactcaaatccccatctgtggaaaaattgtcttccactaaatccgtccctggtgccaaaaaggttggggtctgctcatctatagaatctattcttctgagtgtgtcaagttatttattggacatctggaaatggagaagggattttttttgtctactctttgctgccatccagtttgggaaaattctcgcaaaaattttcaaaaatttcaagcatcttttacaattttcgaaatatttccagtgagtttttcagaggaatccttaactggtcctttcagagaggaaaaaagtatccagctcacctacatatctcatagttctagtttcacatttatcttgttcactttgttttgtacgtggaatacgtaaacttgtcaggataaatttaggttgttcacataagtagatatatttgtcaagatatgcttatttgcagagcctgtctcaggcatgcacatgatctcacaaactgaagatttcttccagaaatatttgaaatttttcctgcagctcaaaaggatgcatgaagagttttccactctttttgccaaactctatatgtagccccaattttgaagttacttttataaggttttaaataaatggttttgaactgtaatgactaacaaaaggcatgtgaatgatagtgctagagatgctgccaccaaagtaccaagaaagaatatcatgcttgatgataaaataaaagctttggagtgtctcaaattggctgaatacatttaatgagctattagaggaaacatggtaaagatggatggtcatttagaaattctaaagtcctgtaatgttgaggaagctaaacattatcaaatcttggaagaagtaatcaatataggaagaagaaggaggagaagcaatactttggatactaagcaatagtttcaatactaagttgaaattacttagctaacctcaatttaatggactcactacatttcctctgcagaacatgacttttacccagtgagttaaatgcttgtgtctcatggctattttgtagtgtgtctgaatgcttctacttcgtccagttgaattgtataatctcaacccgttgtacttgaattggaattagatgatttagttaaatattatgaaaactgaaaactgatgaaatctgagcaccaaaaagaaagttatttctataaacagtgagttgtgtgtgctttggaaataagagtagagacttgtcactgaaaaaaaattctgtcaaattagacgtgtatacaaaacaattattatttggaaagtatcttctagattattatgaatgtctttcgtttcttgctccactctaaggaaacaggaaataaatcatagctgatatattttaggacagtttataccagaaagctgatgggacactccaatcaacagacccctacttaaagaaacagccaggcgcagtggctcatgcctgtaatcccagcagtttgggaggccgaggcgggcggatcatgaggtcaggagatcgagaccatcctgactaacacagtgaaaccccatctctactaaaaataaaaaaaattagccgggcgtggtggcaggcgcctgtagtcccagctacttgggaggctgaggcaggagaatggcgtgaactcgggaggcagagcttgcagtgagctgagatcgcaccactgcactccagccttggcaacagagcgagactccgtctcaaaaaataaaaaaagaaaaaaggaaaaggctttgatcctacattttaaaattggcaaatgaatgtacatttacataagttgaaataaagtttaaggtttgtatgaatggtttttaattatttcctgctttaactattcttttccattaaatgaccaaccactggtaccagtggattggataagacagttggcactgcgtggataaaggaggtttaaagaaaaggaaacatgaaatgccttctttttgaggctgctacaataaccaagttacaagtgtgctgattaatttattattcctgtttccagaaatgtcttatttgtatttcatttttaatatttttaaatttaatagtttacatttcccccactagtgttgccttctatttgtagcaagttaatactggttttctatttataatagtgagataaagtttcctttggaaaggaatgttacctttaaagaaaaacattaggtgactaataatttggtgcttatgtgactgtggcaaatcatgaagatagtattttaagtatggaaaacaattgctaaccagcaagataatgtcaagttccttaatatgaactcacttcttggcctttgtctaccttctccagcttcatgtcttaccactttcccttattatggacttcatgttgatcaagtggaggctccctctcctcaaggagagtccctaggccagattcagaagatggttggtagagaggggatttgatagcttctgaggacagtgctttggatggagaaatatcatgcaacttaggacagtgctttggatggaggaatatcatggaactttagttttccagctttattgagctttgcctgtgatattcacttgtttggggggctgtttggagacagggtctcactacattgtccagacacaatcaccatgtactgcagccttgaagtcctgggcttaagtgatcctcccatttcagcctcccaactagctggaactacaggctcgagccactgtgcctgactcttactcacttttttgttcccaatacctggaagaagatcgtcagtctgtaaatatttgaaatctaaataagggttatggtgctgtagtataaggccaaatcttgggcaccaaacaaaaaaaaatttagaaaaatcccttagcccatcccatgctgtgctgggagcttcatctttctttttaattgcaatttaaacgatctactgctacaagagggttgtggtaaagcagaatttcttatactgtgcaggtgggcatgtaaattggtttaaacttacagaaaataatttgacaatatagttcaaaagcctaagaaatgtttaaactttttgaattagtaatgccaattttggtatatatctcaagacattaaggatatacagttttagctgtcattttatacaaagagatcacccacaccattattttagtaggggcaaagaggaaccaatgtaagtctggtgcctctgaagaggtagacctagaaactgggatgacaaggaactcccaggggactgctgttaataaattactttatgtcatttgataaaatatatgtaagcattaaagacattttcaagtaaaccttagtgaggaaattgttcatgatctgtgaaaagtatgggataaaacttcaaatataatgccagttacatttttaaaaaacattcatgtgatgcttttaaaaagacttctaggacatgtaccaattttttttttttttttttttgagccaagtcccactttgtcgcctaggcttgagtgcagtgggcacaatcacagctcactgtagcctcagcctctcaagtagctgatactacaggcacacaccaccatgctcagctaattttttaattttgtgtagagacaagctctcactatgttgcccaggctggtctcgaacttctggactcaagtgattctcccacattggcctcccgaaatggtgggattataggcacgagccactgaacctggcatgtactactttttaagtgtttctgggttgtgagattatagatgaattttgttttattcttcacactcatatgttgttttctaggcttttaactatgtgtatatatatatattgcctttgtcatgagagacacttttgtttttaagtgaaacctctgtttagtttttatttatttatttgatctttattttaatggaaaggtaactgtgctggtaagctgatagatgattggaaggaataattcttgagactaggaatgcaaatgaaagactgctgggagatatgagaagctcctgaactagggcagtggtgataggattggagaggaatatcgtgatcagtaagacataggaataaaggaaaaagagggatccaggatgactcccaagtttctgggtgtttaaatgtaatacatttgagatgaaagtttggctcttaaaaaatattcttatttggggaatgtttaaatttagtgaggtcattaacaacttcagattccttttatacttcaattctttaaattctatatgttgccaaagatcctacttctaatttgttagggttaacaagaagaaagatgatatgtctgtgaagacatgtttctgacatctgtcaccctatggattgccagttgatagacctggttgtcttgataagtattagctgactccccaaccagtttatttgcaccacttctgaagcaataagcttggttgaaaaagggcacctcccaagtagggaaggataatttttaggtcaaattatagaaattgcatgtatccctgttaacacttccaacaccaacaaaaaaatagacaggaaaatgaccctaccagctaattctccattataagactttgaagaaaaggttccattaaaaacagaaaagaggctgggcatggtggctcatacctgtaatcttaacactttggaaggccaaggtgggagaattgcctgagttcaggagtttgacaccagcctgggcaacataacaagaccctgtctctacagtaagtaaaaaattactggatgtggtggcatatgcctgtggggccagctgtttgggaggctgaggtggaaggattgcttgagcccaggagtatcaggctgcagtaagccatgattgtgctattgcactccagcttggtgacagagtgagaccctgtctcaaaaaaataaaaccttgaggacccaaatttgatttaaatttagatgtactatctgctttgggagagttactttattattatttagtagagacagggtctcactatgttgcccaggctggtctccaacttctggccccaagcagtcctcccaccttgggctcccaaagtgctggggttacaggcgtgagccaccaaccctgcccttaagttatttttttgatcttttcatgacatgctgtgggcaataaaataatacagtgggtgatctgttgttgcaattcaaatatggagttcctttttcttccacaaaagtattggctgatttctttctttttctggctgtgagcaacaggtaaattaacatgaccatggtctgtccccagcgtcttgactcagatttcttaatttgaacttttccatcttctccactccaagatcacatgacaacatccaacatcagtggatagaaataattagaggctggatgaggtggctcacgcctgtaatctcagcactttgagaggccgaggtgggcggatcatttgaggtctggagttcaagaccagcctggctaacatggcgaaaccccatctctaccaaaaatataaaaaattagctgggcgtggtggcacacgcctgcaatcccagctacttgggaggctgaggcaggagaattgcttgaacctgagaggcggaggttgcagtgagccgagattgtgtcactgcactccagcctgggtgacagagtgagactccatctaaaaaaaaaaaagaaatttaataagtcactgctacactggcaaagaagggttgagtagttttaagaagcttagttgctgtccaacagtcttattgcatctgattcttttggtgcttgcttactcaagtagggatcacatagcatgggaaggaaagagcagatctgtgattctgttgtttacatctcagaattgtggtttgtgaatagttttgaaatttttcttatagttttgggagaaatttgttaacggaatttttaaggattataggacagcacaaaataatttctcttgtttagatgcttttaataataaaaaaaatctgttaggatactttttccttttttttttttttttttttttttttttttgaggtggagtctcgctctgtcgcccaggctggagtacagtggtgtgatcttggctcactgcaacctccgcctcctgggttcaagcgattctcctgccttagccttctgagtagctgggattacaggcgcatgccaccatgtccggctaatttttgtatttttagtagagatggggtttcaccatgttggtcaggctggtctcaaactcctgacctcatgatctgcccaccttggcctcccaaagtgctgggattacaggcgtgagccaccacgcccagcctagaatactgtttaaatgataaaatagctgagtgcagtggttcatgcctgtaatcccaacactttgggaggctgaggcaggaggattgcttaaggtcaggtgtttgagactagccctggcaacgtagtgagaccctgtctctacaaagtaatttcaaaattggctgagagtggtggcacacacctgtagttccagctgtttgagaggctgagttgggaggattgcttgagcctgggaggttgaggaggttgaagctgcagtgagctgtgatcgtgccactgcaccccagcctgggtgacagagcaagacctcgtctcaaaaataaataaataaaagataaaataagaccgaaagatttcattatgggatagagaagaaaactaatatggaatttaagataatattcttatatttgagtggcctctttttttgagacagggtctcactcttattgctttggctgggccacagcggcatgatcttggctcactgcagcctggacctcctgggctcaagcaatcctcccgcctcattgtccatactgtctagctatctccatgataacaacatcatcttatatcatgactactgactaaaatccttagtagctgggactacaggcacatgctacaatgtctggctaattttttaattcgtttatagagatgggggtctccctatgttgccgaggctggtctcaaactccaggcctcaagagatcctcccaccttggcctcccaaagtgctgggattacagacgtgagccaccatgcctgacctgagtagcctttttatttaaagggaatcggcatttgtttattacctggtatgttctgagtatcaggctgtgtacttaacctcacttaatcctgacagcattcctataaagcagatacctaacaattatttgtgaggaaattaaggttcagtgactttccataaatttgcttatggtcacacaatccattgagtgcttgtgccaggttttaatctcagtctgaccaataccaaaactcattttttctatgtatgtttcccttttagaaagattttatttttttaattttaattttaattttttaacttttaggttcggggtacatgtgcaggtttgttatatcagtaaactcttgtcatgggggtttgttgtacagattattttgtcacccagttactaagcctagtacccaaaagttattttttctgccccctccctcctttcaccctccaccctcaaataggccccagtgtctattgttccctagaaagatttcataagtaaatgtcatctagcctgtaaattatttttgtttgccagcatttataatataggtggtcattctttaggtgctgaaacagaattggttttgtccttagtgtctggctgtctccaatgataacaacatcgtcttttatcatgactgctgactaaagtactatattctcaaatcttcttttcttctttttttttttttttttttctgtgacagggtcttactctgtcccccagtctggagtgcagtggcatgatctcagctcactgtagcctctgcctccagggttcaagtaattctcccacctcagcctcccgagtagctgggactacaggcgcacacccgcacaactggctaatttttatatgtttagtagagacggggtttcaccatgttggccaggctggtcttgaactcctgacctcaagtaatctgcctgccttggcctcccaaagtgctgggattacaggcatgagccatcccactcggccagatcttttgtttttaattgaaaacttataatacatttcagagataaaggagagctatttcagaactggtgcttattggtaagttttaaagagttaaagtcagtgaactggtggtataagccatttaatcattatgtttatcattttatagatactaatcggagtaatgcagtttcaacaaaagtagtttattttggggtatacaagaatttttattctttaagctaattaattctaaatttaaaagaaggaaaacacctgagaagcttgcgctcttagtgttactacacagaagtctcaatgtagctgcaacatctgattttaaaattttcttttttcgtcttatacttggaatatttcacaataaagtaaaaagaaaatgatatacatccatgtacctgctacttagtgttatctttttgggggacgaggcaagcaaataaaaattagagatgaagtcgaggctcccctgggtattttcccccgatcctgttctcttctgcccctttccagaagtaaacatcatagtaaacttggtgtttgttgctcctatgcatgtttttatactttggctatatgttatgtatcttcaaacattatggaaatttttgcagatttttaaacttcctaacatttgaattcatgttctatattcagcaatgtgtttattaacaaaatatcaataaaaattactaattataactgttactattaataatgaatattaataaaatattatgaatatgatatgaggtagggattgagttttattctttcatgtggagaatcagtcgtctagccccattcactgtgcagtctgtcttttccctactgatgggtagcactatccttgtcatacataatgtttccattatttgtaggtttgtttctgagctttctaatcttttcccttggtttgactatttctgtaccgacaccaaactgttcagattactttagcttcataagcaaagtaaatctccttaccttgtttttcttcttcaaaattttcatcgctattcttagctttttctttttccatatgaattttgggatcagcttgtcaggttcccttaaaagttttatttttttttaacattgtaattgcattgaatatttagtttagtttggagaaaataggcatatttatgatattgtcttcctatacatgaacgtggtttttccttagaaattccagatattcccttatggtcttcaatagtaatttataattgtatccaaaagtcttaaaacttttttggctaagcttatttctaggtactttatgattttctctgcttttagaatggttggtcagtctctttctttccctctcctcctccctcacttattcttttccttcctgtttcttccttcccatcccccattccaacctcctttcattttttttttctctctccttccctcccttatcaccttttaattttatattgttttggctgacagttctatttaaggtagtgtgttatagagaaaagtatatggaacttagagtcaaaattgctggaaatgagtccccgcttcgtccttcaagaattatatgataattaagtcaacttttctgagcctaattctcttaatctgtaaaaggagaatatttacttttatactgtctacctcacagaatcaagtgagatatgtgcatgaggttttttcctaattaaaaattcagtgctaaaaagagttctttctaggggaaaaaaatgccaatttcccccaactaaaagtatagacatttattaaaactgtatctttagggctgggtgcggtggctcatgcctgtaatcccagcaatatgggaggccgaggcgggcggatcacctgaggttgggagtttgagaccagcctgaccaacatggagaaaccctgtctctcctaaaaatacagaattagctgggtgtgctggcgcatgcctgtaatcccagctactcgggaggctgaggcaggagaattgcttgagcccgggaggtggaggttgctgtgagctgagatcgtgccactgcactccagcctggtaacaagagcgaacctccgtctcaaaaaacaaaaaactgtctttaaagaagaataccttaatacataaacttattattttgactcttaaagattataacccttataccccacttcctaaaaaaggatgtgaaatggtttaaagggcacgtaaacatacactcacctcagttaaagatgttaaaaatagaaaatcaagttattacagtgagatcagtgcaaatatgataattatgagggctaatacagccattgtaattaagcctctctgctttcaggattctgtgggaataaggtaaatatgatttggttctattgttggatgtatttcctcctttgagacaaacctaattttactcccattaaattaaaaaaatactgtccaccaaggtttcaagacaatattgggaacaatatctgctacaacagtttcataagtgaaagagcactttttcaaatggttttttgaatgaccgttactaaaaatctgaggggaaaacagaaagcagcactcaccaaaactgatttctttggaaaaactaaaccaaggttatttagatagcttatgatctaatttgtcaggcactgagctggtttataacctagagcagtgatgctttcaacatttttgtgttaacacatatgaacttttgaatactaaaatttttggtaatatgttgaaacttccaagggaacattagataaagtaatagtaactataaggtaaccactagtacagtaaaaatgccttctagttacaaatgaatccaaagcaatctctattttacttaacactattaagcactgcagtctgagtttgattagaactgtttactctctgatctcctctgatcttttttttttaattcaggaaccaaaatatttatatgttctaatatagatataccatctttaacattggcttgaaattatgtaatgcctctggattgtagttatttgtgcttcactataccctgtcatatactggcccagtacaaagttctttctgacaagcctttctaccagtgtgttattaactagtttgctttgtataatgcagttctgctctcaaatacatctaggcaagtaaccaaaggaatcctaggttaactttctgcatttgaaagatgtatttatggaagactgaagcttattttttatatggtaaggcaggtgctcagtttttatggggctttttttccctataatttttcaactttttgtaaaaagcagacaggatttatgataagataggcctgagttcagatccaggctctaccatttgttagctgaacaaccttggaaaagttatatagcttctctaccttagcttttgtctctttatccccaatatctcttatcatgtctacttcataggacttcagatgtgaagtttttaaaaattatcaaactgtaacttattgataattttctgcttaaggtcactctaactgaggaacctacccctagaattaaaaataaatgcacaaaataagctattaataataaatgttgaaaaaagctattccgtattaccagtataatctaaactgaaacaagattttttcttagaagtaattttttctaagtataacaatgctttaaaataaccattatataaaatttctgacatagataaaaattagaatagcttaatgaaccttcactgacctgttaccagctttagtaataaaatacagtttagattaatccttttcaaccatataagatataaagtgacaaggcccctcccctctcccagttgtttaatatgatttacctgaggtagccaccattaacttcctttacacaaatgaaatcaccccataggtgctgttttgtagcttgacattttcatttaacaatatactttttaaaatatgttttatttccatgtgagtacctatgttctgtggctatacaacattctgttctctacaatgttctatataatattatggcagcaaaacacaaaagagtgaaatgagggatgtttgttttatccactgctgtgttcccaacacctagaacagtgcctgcacataatagatgctcaatacatatttggtgaatgaattaacatctagttaggaaatgtatttctaacttggaaatgtatttctattattggtacgatattctattatataattgtataatgatttatttaactagtagaataatgatggatggtaggactttgggtttttttcacctttctatgtttttttcccccttctatgtttttttcccccatattctcttcagggagcaactattatcttgataatggtggcaatttaagaaactactttgagaaaataattaaaatatgaaaaatggattttttgtttttgtttttgagacggagtttcgctcttgttgcctgggctggagtgcaatggcgcgatctcggctcaccacaacctctgcctccaggtttcaagtgattcccctgcctcagcttcctgagtagctgggattacaggcatgcaccaccacgcccggctaattttgtatttttagtagagacaaggtttctccgtgttagtcaggttgggctcgaactcccgacctcaggtgatccgcccgccttggcctgccaaagtgctgggattacaggcgtgagccaccgcacccggccaaaaaatgtatttttatggacacccatagctaaatgtctttccatctagtggctggttaaccaagcatggttcctcctgtttcctttccctatgatcatttcagagtataaccattgtttagtgtaggagagatgttatgacttttagatatgctttttttcataaaaaggaattgcctagttagaattttttaaagatatctcacagttcagcagttttgacattgctggggaaattttatccagggatacagaagaaacgttcattcatttttatttaagcacctataaaaagtaggggggtacttctggcaatacagttgggttactgtttgtggctaaatatgtgtgtgaacattacgacatttgatgaaaacagcttcattgagctactgagctctccagctgatttttcttcttggccttaaaggtttacaaggctaagaatcaatctcctctggggtagatggccttacggattttaaatatgtgttgtgataaaagtgattttactctaatacagcatagtacaagttaacttccagtatgcagaattgacctcgtgaattttagtttaatgatctcagttctcatgaacttgcaaacatagaaaaaaaataaatatttttaaaaaacttttctttttaaattgtgaaaaacgtatatgatggttacagcaaagattatgcttttatgactaattcattacattgagtcatacatattaatgattcaaattactaacatagctctattaaattaaatctaccatacagtatacaggtattctgtactttgaaatttcataaatttttggatatcaactctcagaagggtatactagtaatttgcttttacccacaaaatcttcagatttgtcaacaaaatgaacgagattggtattttcactttagtttctcagtgaaaataaagaatgggtagatgaatggtccaaagagctaagagagaagacttaatttaaactcaaataaacatgcccagaatgaccctctctttttctgcccttcctcctgccacagttagccactgtatgtctcaggttttaggcaaagtgagtcttcttatcatggaaactgtgaacattcattaacaactggttttactttgaaacttaaacagcaaacaccaaagagtgaattgttggtataatccatgggagtcttgagattgacgtcagaacaccagtacagctgtataagcattgggaagtatttttaacatccgtgttagatcatctttttgacctttccttttatgttttctctttttccattaaatggttaaaaaaaagagctttacaatattttctaccaacactgtaatgatattcttaaaaaaagcacccgtacaattattttctttgttcctttcccctttgcaactttcctttacctgtagtgttccaagttctgatggggtggcctttttttttttttttaaataaaaagtttgtttttgagaacagggctagatttgccgaaaatgagaagctagaaaataacatataccccataggcatgctcagagtcccctattattaacatattacatttgtgtggtacatttgttactgaaccagtgttaacattaatattaattaaagtctgtagtttattcagatttccttagtttttacctattgttctttttctttcctcagaaaccacattatatttagtttgtcatgttccttagcctcctcttggctgtgacagtttctcagatttttcttgttcttgatggttttgacagttcaaatgagtactggtcaggtttcttgtaggatgcccctatattagaatttgcttgatgtttttcttacgatttgactggagtatgggttgttggaaggaagatcacagaggtaaagtgacatcttcatcaactcatgccaagggtacttaccgctaacatgatatgtgactattgatgatgaccttgatcaccaaaataatgtttatcagatttctccagtgtaaagtattggaatgttctggtaggcatatcctagttaggttaattgctctggtaattgcttgggctttagttattaaataaatcatcatattggtatactgctcattgaaatgttaaatttttttttttacaaataatgtgttcagagttgagaattagattttttaaatgttcagattgtattttcaaattgtatttttgaaataaagctttcctttcctgtcgaattctaaagattttgtttatctaagggaacaacttaggttcgtattttaagtaggaagttagagagcctggtcagtttatctgcaatttaaattctagacactgagacttatttccttcattttatcttttaaaaaatagactgagatataatttacatataaaattcaccattatattattgttaatttttatgggcataagtatttatatttatggattacatgcaatattttgagacagggatacaatgcatgataatcacactaaggtaaatggggtatctattacctcaagcatttattctttctttatgttacaaacattccaattatactcttctagttatttttaaatgtacaataaattatggttgactgtaatcactctgttatatcaaatactagatcttattctatcgaactatatttttgtatcctttaacaatcccaacttccccaaccccccactacccttcccagcctctggtaaacatctttctatctccgtgagttcagatgttttaatttttagctcccacaaatgaatgagagcatgtgaagtttgtctttcggtgtctggcctatttcacttaacataatgaccttcagttctatttatattgtggcaagtgacgggatctcattgttttatatagctgaataatactccattgtgtatatgtaccgcattttctttatccatttgtctgttgatagacacttaggttgtttccaaatcttggctattgtgaatagtgcatcaataaagataggagtgcaggcctctttgatatactgacttccttaagttcactcattttaagtgtgtacttcgatgagctttgacaagtgtgtatactttttaaccaccacaaccagcatagttaagatatataacatttccatcaccccaaaaaattgtctctgctttctgtcacaatagttttgccttttctacttcatgtaaatgaaatcatgtacagtatgtaatctttctgtgtctgtcttctctgtctctttttttttttaaagacagtctctgtttcccaggctggctggagtacagtggcgcaaacacagttcacttcaggcttaatatcctgggctcaagtgatcctcccacctcatgctcccaagtagctgagaccacacaggtgcacagcaccacacctagctaattttttagtattttgtagagatggggtctttctgtgttgcccaggctggcctcaaactcctgggctcaagtgccctgacccctgcgaagtgctgggattacaggcatgagccactatgcccagcctttcttctctttttttaggcttaatacttttcagatgcatccaaattgtttcatataatggtagtttgttcctttttcttaccataatagtattacattgtgtgaataagtcagtttctttatccattgacctgttggtggaggtttggattgtttccagtttttggctattttgaataaatctgaacattttcctgtaagtttttgtgtggcatatatttttctttctctttggtaaacatctcagagtagaattgctgagtcatatggtaaatatatattaacttttaaaaaattcttttatttatttttttagagatggggtctcactatgttgtccaggctggtcttggatcagccttggttagggatcctcccacctcaccctcccaaagtgctgggattacaggcatgagccaccacacctggccttgattaactttataagaaactgccaaattgttttccaaagtgcctctgtcattttacattcccactagaaatgtcgaagagttttacttgttctacatcctcatcaacacttggtagtatcagtctttttaattttagtcattgtagtgggtgtgaatggcatctcactctactttttatttgcatttctctaatgatgaatgatattgaggacttttcatttgcttattgaccttttgttctcttttgtgaagtgtctgttcaagtcttttaagaagttggcttgtctttgtcttattgagaggtaaggtatgggtcctttgtcagttacatttagaaaatgtttttctttctgtttgtggcttgtccttttatttccttaacaatgtctttcaaagagcataagttattaattttgatgaagttcagtctatcaactttttattttgtattcatgcttcttggtccctatcgtaaatatcttgacttaacccaaggttgcagaaaatgtcctcttaattttttctagaagttgtatagtttagctcttatgtttaggcctatgattcatatcaagttaacatttgtatatggtgtgaggtaaggattaaagtttgtgcgtgttttggcatgttttccagcaccatttgcagaaaagactgtccttttcccgttgaactgctttggcatctgtgttaaaaacttaatagactgtctgtgcatagttgtatttatggtttctttattatgttctgttgatcaatatgcctgaacatattgattgatttattaccttagctttaagtctttaaataaggtaatataagtcttccaattttgttgttttcctaaaaattgttttggctcttctagatctttgcatttccatatgaatgttagagtcagcatgtcaatttctatttacagaaaacaggctgagattttgtggttgtgttgaatctggatcagaatgtggagaattgacatcttaaattaggtctcccaatccattggcataatctttctctccattaatttagtagtcttctttaatttctctataaacattacatagttttcagcatacagggtttgcacatggtttgttaagtttatgtgttttgaggttataaatagcatttaaaattaatttttaattctttattaataatatatagaaatacaattgatttttctatgttcatcttacatactgttactaaacttgctttttggtgctttttttatatagatctctggagttttccataatgtcatgttattaaaaagttttactttcatttaaaagatgtaagccttttatatatttattttcactgtcttactcatttggctgaaatgttaaaagaagtggtgaaagcagacatgtagacatcttttcattgttctcaatcttatggaaagcattcagtattttaccattaagtacgattttttttttttccatactctatcagtttggggaagttaccttctattcctagcttgtaagaaattttataattaacagatattgaatttagtcatatgctgtttctgtatctgtttagatgatcatatggcttttctgttttctttcttttttttgacttgccaggaggtattttcatctgaggcttttctttcttagactggtgatacagtgaattacattgatttttgagtgttaaacctacctggcattcttaggataaaccccatttggtttatcctaatggtctctttattatgtattatgtattattctttttatttattgatagatttggtttactaatattttgatgattgttcttgttcctttgttcctaagggatatttgtgtttagttttcttgtaatgtcattgccttgttttgatactgagacagtgttggcctcagaaaattttttgggaagtgtcatgtgttttcactttcatttgtcagatgtagaattgttatctcttcctttaaatgcttgtgataattcaccagtgaagtgagttttctttgtggaaatgttttcaaccagcaattaaattcactgccccctgagagtacccactattctgacttctagtaccatagactaatccttaaactttttttggattaattttttatttagagaaaagttgcataaataacacagaaaattcacgtagagttcccatataccctacacctagttttcctgattgctgacatcttacattattgtggtatatctgtgaaaactaagaaaccaaccttagtacatactgttaactaaacttcatacttcatttggatttttccagctttttcattaatggcctctttctgttctaggatcaaatttaggataccacattgcctgtagttttcatgtttccccagtctcttggtttgtgacagtttctcagtttttccttgtttgtcacgaccttgccatccccgaggactttgtagaatgccccccagtctgcgtttgctgctgttgctcggtattagactgggttatgcgtttttggaaagaatcctcttttcctctcatcaggggtgcatgatgtccacgtggcatcactggtgatgttaaccatgaccacttggttaagatagtgtttgctaggtttcttcactatactctgttttttgggaacacattactaagtccaacccacactttaggaagggggagatatctacatacatggtttgaaattcttctgtaaggaagatttggatctttccccacatttatctgtttattcagtcatttatatcagtatggactcatgtatgtttattttatactttgagttctaatgctaggtttcttttcttttgcttaaattgttccaactttggctattgggaaggttttccggttactgtttatgtccctttcatatgcccctatccttttgttttttgaacatctcctgacgtggtactagaagatgctccaggctcatcttgtattttctttgcatcagctgtagaatcagccatttgaaggaactagcattccttttatttaggaaccaaaatgtagttactaggtgtgctcattgctattggagtatcgttgcttttaggccctctcaggggacagagctaggtaatatctgtgtgaatactaacccatgtatacacatacatctctaattgtttctatatgtatcagttggcatatatgttaagttaaacatgagttgatattgatgtctctgattataatccattaccacaaggttcactctagtcctcctttttaatctgtgacttccttgtctgaccataagaaacctggctccagccaccccattatccatccacttattttttcaacctatgtacacatgaaaagcaaatttagaattattaccccataccccatgagtacagtatttatgtacagtttcttttgtcattagccttacaatttcaagtcaaaacaccgtgttccaaagtttgttaggtaagctcctttttcaccgccccttcagtgaagttatgtcatacatttgtaatgcagttagtttcatttgtcgcaatccacatttcatcttgggatcctctgacgttttggttgatgttagtggttgttgtttggttaacatttgttgaagttcactctttgtactgtgccattctgtgggttcagacaaatgcaacgggtcatgtattcaccaccctaatgtacagcgcagatcctgcaccctaaatgtccccctgtgcatcccgtttgtagtcaaacactctcctctcctctagtccctagcaactactaatttattttctgtgtctctacttttgcattttccagagtgttgtataaatggaatgatacagtctttggatttttccatgtagtaaaatacatgaaaaatccaaagattgtatcgggcttctttcatgtagtaaaatgtatttaagattcatccatgttgtgtaaattaatagttcatttgttttaaaaattgttgtactattccattgtgtggatgaatcataatttgttttttcattcccccattaaaggccattgtagttactttcagtttttggcattaggagtaaagctgctgtaaatgtccatggccaggtttttgcatggatataagttttcaagtcccttgtgtaaatacctaagagtatgattgtaggtcgtatggtaactctgtgtttaactttcgactgcttttgttctttatagaaatggagttgtgcagtatgtgctcctttttaatctagcatctttcttttgaattgtttatgacatttatctgtatattttgagtggtcataattcatttgcattattgattaatattctaatgtgtgaataaactacagttttaaaaatccattctactgcagatggacatttagatagctctagtttgggactgttactaacagtgctgtttaggaaccttcacagacatgtatttttgtgaacatacatatacatttctgcctagttgtggaattcgctggtacagctttagctgattgtaccaagtaattttctggagtgattgtaccaatttatagtctgatcagcggatgtagtttctaggtgcttaatgtcttcatgagtactgtatgtattcattcattctatttctctctctctctcattgtggttttaatttacatttccttaaagttgagcacctttttatatgtgcattggttatttggatattcagaaaaattaagaaaattgtaaatttcttctgggctctgaaagcattggggtttggaataaggggtggcttccattaggaaaggcagtaagggggccgggcgaggcggttcacgcctgtaatcccagcactttgggggccgaggtgggcagatcacgaggtcaggagattgagaccatcctggctaacatggtgaaaccccatttctactaaaaatacaaaaaattagccaggcgtggtggcgggcgcctgtggtcccagctgcttgggaggctgaggcaggggaatggcgcgaacccaggaggcggagcttgcagtgagcggagatcgcaccactgcactccagcctgggcgacagagccagactccgtctcaaaaaaaaaagagaaacagtgtctttgggggagagccaggtgttggtgaaggcagcgtttggagtgcattctgtgaagaagttaagagtgtagtggtgtttggtttcttgtagcaagagtcctagagcagtggtccccaacttttttggcaccagggaccggttttgttgtagacagtttttcaatgggactgggagggtgttcgggggagggcagtagtgggatggtttcagggtgattcaagcacattacatttattgtctaccttattttcattattattacattgtaatgtataatgaaataattatatactcaccataatgtagaatcagtgggaaccctgagtttgttttcttgcaacttgacggtcccatctgtgggtgatgggaaacaatgacagatcatcaagcattagattttcataaggagtgtgcaacctagatccctctcatgtgcagttcgctatagggttcctgctcctctgagcatctaatgctgccactgatctgacagaagtggggctcaggtggtaatgcgagtgatggggagcagctgtaaatacagctgaagcttcacttgctcacctcctgctgtgtggcctggttcctaacagatcatggaccagtattgtctgtggcccaggagttggagacccctgtcctagagtacacagtgaaaaagtttgatagagaggggaacagtggaagattttgttagatatgtcacatgattaatggatgactaaagttttgtttggtgatctaggatgatagagatgttgagacatgaaattagttggcttcaagttctaagctgtcctgtgtgagaaattgcctcatcagccaacacaggctttgacatatgggtagcttcgtgtttcttaggatacttgggctggtcagaaagtgccaagcatcagagaaactgagacctcggtataggtggaggaagtctaatgatagccacagtcagtagcctagtctgatttgtttttagcaaatctagactattttcttaatcagtaactacttctttagtaactacttacaaggcgactgcctttgccaaggtatatgttctctgaaagctgattcttcatagatcactaactgtagttttgaggttctgtgatttccttcaaaattcacagaaccttgagctataatttatgtggatagagtgattactgggatttaacttaaaattagatgtattcaaatgttttaaggaatatgttttgtaaaacaacatgtttttcattcgttacttatatattgatcccagaaattgtgtgcctgcaaattgtcaagttgggttgatgcttcagaaaaggaaagtagaggctgagtcttcttagtatagcaatgcattttttagagcagtgtttgaggcaaattattttcgcaaaattacatggcttctagggattagattgcatgagtttgtctcttgttcctccctcattctactgtaagaggccaggctgctagttaacagaatgccagacataatgcctagggcatagtttgagacctgggaagattcacaataatcaaacacaaacagacagagtagcatgaagaaatttcaatcctcccagtcttgcttacagatttaattaggcttattggggcagaaaatatttttcctccccccatgtttaaatctgtttctcctctactcccacctcctgtcccagattctctttgaaggggtaatactagcaacaaaaggagatttttttttttttttttgtaaatcctaacttatttggtttatctggctttaggaaaaggagcagtaacaacaaccgaattttaaggtatttgagggactccattttttggcactgtatttgggaaattcccaatttaaaaatcatgctgtactcaagaagaaaattagggtttttttgtggctttataattggatcttttttgcaagtatttttaattttatgagaggtatttggcctgttctgctagagaattatcagccaaatccttgctttctttatattatatatattttcctgagtgatattctagggaaatgtatatggatgctgttctctgtctttccattagcagcgcagtgttgggcttcgaatgatgatggtagatgattgggggtgggagaagaggtggggtttcttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtaatctactgcagtctttgttttctgggtcgtgtataaaatggagcaaaatggtagaaaaatagcttcagtgaaagggatgtacctgttaacaggaataaaatagaaaggaaaaggatatttttacattgttcattattatttctcacaacagcttttaggatttttatcatgttttaaaaaacctaatttgacctaaggaagaaaattcctagttttgaaaacccgtgccttaattgcttagctttagaacaaaggtttttacatccagcattgcaaggatatctttattcaaaagaataggatgcagcattcttatgttacctttttagaactgaattggcataacctctcttgaatcttagagactttgacgtattattctgtgaattgtgatttaattatctcatgcttcaggatggttgtttccctttgatacccaagagaccatggatgggatatagggggtggggattaatattacagtgggggaagggagtgtttttacagagtaaccttcctgtttttgcattggaaactaaattgaaatatataatcattggaaaaggtggtatccatggcaccaatcttatcaacttgaattattttatcctttgttcagtttgtggtatttttgctcttgtcagctgaaatgttgattataaatttgaagaagctgccgagttgctgtgatggcactggaattgcattctgctttctttttctttccaattatagctgtaaatacaggaaccaagggatgaatgtgaaaagaagtaatataaaatgctgaagatatttttggttttctcttgaaagtatttttcatagtgagaattattttcttgtggacagaaagagctaggaccctaatttatgacattaaaaagcatttaagtgctacagacttctctatttaggaaagacagactgaaaacatgttgaagcgtactatggagctttcagttaagttgattatttccatcatggtgatatgagttatcatactgtttgccacattttgaaagctgtttgactcctcagaagtattaacaaattaacaaattcttactgagcatttacattatgctaggttctttagatgtatatcaggtttatagtctagtaaaggatataaaaaactcatgcatatgatgtaccatttttggtgcaagcatataagtattgcagtgttatatatttatgtactgacatgtaggtgttttacataagctactacatttaatcctcataacaacctagtcacgaaattattgtcattcttgttatcctatgcacattagtccaaacaagcaaacaaaaattgtcattctcttttatagatgagaaaatttacattttgagagattaagtgatttaccataagtaacaaagccatgaagtgatgaagcctgggtcagtcagactctaaagctctttccactgtttgtatatgagtagattaaagcattttatcatgattatttgacatcacaaatagtgatgccatgagtgaaaaggagatagggatcctaatctttaatctatgccaagaactgagtgattgagcaaatcatttaacatcgtctgtaaagtgtgagggttggactaggcaaccttggttcatgattctattcagtgtaagagattttcacatatggtctatggaaacaattctcattactttagtgtttttattatatttagtttccattactcatccttcataatgtgctgtacatgttggattgtgtgtggtggggggggagggtgatagagtgcatatcatcttctaacatattacatacaatatacatttatttattaagattattactgtctgtcatcttccttcttcccttcccccaaatatgtcacgaggacctagactagagcctggctacatagtatgcagttataaactaattttttgaatgaatgaataggaataatagacttgtatagtacattggcaaaatatataagtaacttcataattcttaacaccaaaagattccctgggggccaaaattattaatctttctattacagtgatcctttaaggaactaagtgtaagaatcttaaaaagaagaacacctacgaaacaatcaagtgtagtcaagtaatctgaagtttgctggaattcccccatacaaaattattggtagtatagaacttgctaaccataggtttgtttacccagtgttctatttgaaagtagtttactaaagcattccatataagcaaagaaaaaaagcagcaaagtttcttttttgtttatgtgtcactgtatagtctcaaatgctgtaaatttacagtgagtagaaaatattcagaccattgagtcttttgcttaaaagatatttcgtaaggtataacataacgtttactggtagttttgtttcatttaaacattaggcttcttgagagttttaacagttttattgaaatgtaattggtgtataataaactgcctatggttagagtataatttgataggttttgatgtatatacacgattaggaaactatcaccacaattgagaaaataaacatattcaccccaaaggtttccttgtgcattttcataatttctccgtccctccacccctcctcacctatccccaggtgtacccattgacttgtctttggtccttatagagtagtttgaattttcttgctttctttcttgtcattatagattaatttgcatgtctttttgtaagtgaactcacatagtttgtgcttttcttatgtggtctcttttactctgcataattattttgagatttgtctgtattcctgtgtatcagtagttcatttctttttattgctgaatgatatcccattgtgtggatataccacagtttatccattcagctgttgatgggcatttgggttgtttcaagttttagactattaggaataagtttgctttggacattcatgtacaagtttttgtgtgtacataagctttcatctcttaggtaaacacccaggagtggaatggctggattatatggtaggtatatattttaactctttaagaaattgccagactgtttttccaggtgactgtattgtgttacattcccattagcaacattccagttgctgcacaacttcattaatagttggttttgtcagtctttttaattttagccattttactgtgtgtgtgatggtatcatattgtagtttttatttgcatttcatctgatgactaaaaatgtttaacatattttcatgtgcctgttttatcatccatacttcttttgtggattgtctgttcaaatcttgtttttaattgagcttttaattattgggttgtaagagttccttatatgtttgggatataagtgcttttattttttttttattttattttattttgcgacagagttttgctcttgtttcccaggctggagttcaatggtgcaatcttggctcactacagcctcctcctcctgagttcaagcgattctcctgcctcagcctcccaagtagctgggattacaggtggccaccaccatgcctggctaatttatttctagttttagttttagtagagatggagtttcatcatgttagccaggctggtttcgaactcctgacctcaagtaatctgcctgcctcagcctcccaaggtgctaggattacaggcatgagccaccatgcccggccataagtccttttaggtatatgatttagaaatactttctcccagcctgtggcttgtattttcattttttagcatcctctttctctctttaatacttttattgagatataattcacatttccttgagcaaaagttttaaagtttgaattctaatttatcattttttctttcgtagattgtgcttttgctatatctaagaaatatttgcctaacccaaggtcacacctctttgcttctagttttatagttttgggttttacttttaggtctgtgatacattttcaggtagtcttttatttttaatttttgtgggtacctagtaagtgtatgtatttatggattacatcagatattttgatataggcatgcaatgtgtaataatcacatcagggtggatggggtatctttcatctcaagcatttatcttttgtgttacaaacaatccagttgtactcttttagttatttttaatgtacagttaaactattttttactataatcaccctccactacccttcccagcctctgataatcatccttctactttctgtctccatgagttcagttgttttaatttttagcttccacaaatgagtgagaacatgtgaagtttgtctttctgttgctggcttatttcacttaccataatgacgtccatttccatccatcttgttgcaaatgacaggaactcattcttttttatggctaaatagtactccattgtgtatatgtaccacattttctttatccatttgtttgttgatagatacttaggttgcttccaaatcttggctattgtgaataatgctgcaaaaaacatgggagtgcagataacccttcgatatccaggagtgtcctaaatctaaggatgtgtcatattattttttctttatttttttctcctcctgctgttccgggtctctacagtgtcccctactcctttgttttattcgcacacctgggtagtgcctttccaatcaaaggatagttgggtctgcatttcaggtctgtgatctttatgtttagggaaatccgtttcctggtcaaagcctaccagacttccttggtatcactccagaatttaacagatttggcaagtatgttttttagttaatggtttgagatcataatcatttccttcatgctcctcctgccttctatttttgcttttaatattgaggaatgctaatggaatagatttgcttttgctctctcccatctttacctggaattgaacacatatttattgaaggaatgagtggtttgcaggaatgttgccattcaggtggagacatgtttctctttaaatatatagctggcaagttgcccatatggcacatagatattaactgaattatccactgagctctgggattaggagatacagattgtgtaggattgggagttctttctattggcttatcttttcctaaaactatgtaacgggatatgaatacctttctacctaagtatcttgtcattatactagatctagttttctgagtctcacttgtgaaagcttttggttaactattaataaaaaactgtacaaagggaagatgataatggtttctcttgtaaggtggtagtccaggggttgaaagcaagggttctagttagactgtgaggttttgaatctaagctccctcttctactagttatataacttgtatatgttacttaacttctcagaacctcacatttctcttcaataaaacaaggctaaacattttacttatagaattattgttaaaattaaatgaattaatgcataaaaagtacttaaagcagatactgtaagtatgcaagtaaagctactcaagttttagctattattgtaaccattttaattgttaattattgttcttatagataatggatgatgtgtttgaagctatcacctagcacaatttctgactaccaaatgtagtttgaggcttttgagtgtttttcacctaaccattcttcccaaatgaatatttttcagggaagctaaccccaggaaatgtgacacaatttactgtattgttccttacctctataatgtatgtttattctagctggttcatctcttccttatatacaagttccacagaatgatttttttctaataagaattaagaaacctttgttctgatgatgagcttatttaaatttgggtttaatttgatagaaaattaagctgtttccttaatggggaatctggccaatcaccatcctccaccctcccagggtagaattttttccaggaattaaatagctctatctagcagggtcttcctgcctttggcagtagagcagtacaaaggccacattgagcatagctgctggggaaaccctttttccttctctagcctataaatgctgttctgtctctgtgaaaagccctgacatcagctcttggaaaaatccaaatacttgtgttagaacaaggctgaaacacttgcctgggcagagactaatggctgaactatagttctaagtttaccagattgcctctcagtattgttatgctttaaaaaacaaaacaaaaactgtaagtttcagacataatctagagaaattaggatagaaaggacaacttaatagcgcctcccattctttgctagtttcttcttatttttctcttttttctaaaaatctaccttcaagataatgtgaaattcttgcttgaggagtgagggagagaaataatatatcaatattataaactttatgcagtgttttccacatattagatgctgcataagtatttgatgtttgagacaaaataaactgtaaacagactgtacttaacttccttagtgttcaaattagatcatgatgtaaaactctccagtggttttccattatattatgaataaactctaagcctgtttctgtggctcacattcttacattagctggcccctgtctacttctgtggatctcatttcagcactactttactactctcttggtcattttctatgcttaagccacagcggactttgtatttctcaaatacattaatctgcttatcctttgtgactcttgtactagctgtttcctttacctgtaattctgtggcccacatcttcccatggctggctccttcatttaagtctcagcttaaatgcctctaaggtcttttttgaataaactaaattaatgtatttagtcaaataatatctttttttaatagcacttaccacgatttgaaattctttggtacaattatttttttgtggagtttatcttcctcctgtggaatgtaagctgcttgagagcaaggaccttatctgttcattaacgtaacctccagtgtcttgaacctcctggcataggttggtgtttgtgtaactttgtatgtacttggctgcctgtaacggaaaacacaagtcaaactgacttaagcagtaacgcatttactggctcacataaaaaagaaatctagacgtaggcttcagagatttttgatttagggacgtaactatgtcaagggctcagatgctttccatctttacactcttgccatcaaaatcatcctcatcctaaactagtccttaaagatgaatgcgaagtagctgttaaggctgcttgcttcttcactcaggttcagtgggagggagagaaagaagtttcacatcattctctcaagaataaggaaatactttcatagatgccaccagtgaactttgtttctacttttattggcttttttggaaccaattgcttacccaagaatggaattactgttaggccaaaaaggcccatcactgttgctacagatggggttggcttgacctgagtcatctggactctgagaggaatagtagataactgaataaaatcggagttctcttaaaaggaaggctgtggtttctggggtaacttatatcctctgtagttctcaataaaaatgtatggaatgagtgaattcatgtagtaaaaatgtattgaattgtcaggcgtatgctcagcaccataatagttaagtagaatacaaaatcaaatagaatgtggtccttgccttcaaataatttaaaatctagtgagagagccaaattaacggaatattaaaattgttttaaaaatcagttgattaaaataatttaaaagatgaaaaagagaaaagggaaacaacagatgagacaaatagcaagatgatagacttaaatacattagtaatcacactaaaggtaaatggtccaaacaccccaattaaatgtatagactatcagattagatgaaacagcaaagcccaactgtatgctacaagaaacacaccttaaaattaaaaatacacattgtttaaaagtaaaaggatggaagaagatgtgccctgctaatctacattaaaggaaaactagaccacattaatatcagataaagtagatttaagattatagaatatcaacagggataaaaaaagtaatttcgtactgataaaagggtcaatttaaaaagaagacatatctaggcatgtatacacctaatgacaaaacatcaaaattcatgtaacaaaagctgacataactgaaaggacaaatagacaaatctacaaacattgtcagttatttcagtatccgtttttcagtaattgatcaaagtagataaagtaagcaaggatatagagtacttaaacaatactgttggccagtttgatttaattacatttttggaacattccagccaacaaccaaatactttttttttttttcatgtttgcaagcagacatgggacatttaccatgacagacacaattctgggctgtgaagtaaatttcaataaattaaaaggattcaagtcatacaaagtatgtttcctggtcaccatggactgaaattagaaatcaataaaagatctctggaaagtttccaaatattggaaaataacacaattcttagtcaaagtggaaataaaaaaggaaatggcaaagtattttgtattggatgaaaatgaaaacacaacatatcagaatttgttggttgccattaaagcattacataaaaacttatagcattaaacacctattagaaaagagagaaggtctaaaatcaatgacatcagcttcttttttttttttaagacagggtcttactctgttgcccaggctcaagggcagtggtttgatcactacagcctcaacctcctgggctcaggctgtccccaccttatcctcccaagtagctgggactacaggtgtgccccactaattttttttagtagagatggggtctcactgtgttgcccagactggtctcaaactcctgggttcaagcaatcctcctgcctcggcctcccaaagtactgggatttcaggtgtgagccaccgtacctgaccaatttcattttaagcaactagaaaaagaagagcaaattaaaaccaaagcaagcagaagaaaaaaaaaatagagatgaaagcaggaatcactgaagcagaaaacaggaaaacagtagcgaacattaaccccaaatctggttcttttgagaaaattaataaaattattaaacctctagccagctgatcaggatgaaaagagagaagacacacattactaatatcataaatgaaagaggtgacatcattacagattcttcagatattaaaaaaaaataggggaggctgggtgctgtggctcacgcctgtaatcccagcactttgggaagccgaggtgggcagatcacttgaggcaaggagttcaagaccagcctggccaacatggtgagaccccatctttactaaaaatacaaacatcagccggcattgtggcgcgaacctgtaatcccagctacctgggaggctgagggatgagaatcgcttgagcccaggaggtagaggttgcaatgagctgagatggtgccactacacaccatcctgcccaacagagcaagactctatctcaaaaaaaaaaaaaaaaaaaaaaaagataagggagcattatgaatagctttatggcaataaatttaacaatttagatggaatgtggttggtaattttataaattccaacaatatatatacaatatgtaaatatatattacatatacataaaacaggaaaatacataaaatatatatgcactctgtgtgtatgtatgtgtgtgtaatgaccgggtagggtttatcccaggagtgcaagattggttcaccttacaaaaatcaggcaatgtaagtaaatggatggtaaatggtggtaactatgtttctcactgtctcaaaggagctaagcaagagagaagactggaatgaacctgatggaattagattagaattagagatatcagtatgaactcatgctgagcttaatatagatacagatatatggatagctacagaaagaattatagatatgttgtattagtctcttctcacactgctaatgaagacatatccgagactgggtaatttataaaggaaagaggtttaattgactcacagttccacatggcttgggaggcctcacaatcatggcagaaggcaagtgaggagcaaagtcatgtcttacatggtagcaggcaaggagagctcgtgcaggggaactcccctttatataaccatcagatctggtgagacttattcaatatcccaagaacagcatgggaaaagacccccccccttcatgattcaattacctcccaccaggtccctcccacacatgggaattatgggagctacaattcaagatgagatttgggtggggacacagccaaaccatatcatgtgtatgtataccccagttagtataacacattcatttccctgctctctctgctgagagggcctagaaatggtgacatctcagtagcagtgagcgcacccagctcctggatcttggttactaaatatcactctccaataaaatagctccttggagaaatggttgactctaaggctgcaatagggaaaatgcaagttgaacctagagtgccttatagtgccacaaacaagaaagtgcccaaacagaagggtgagagcatgtcagtggcataaacgggaagaatttgagcaagagaataaataacgtagtattggattagaactcaaagtctaaaataaacatacatgagcccatactgataaaaatgattacataaatacatgggtgagaaaacacaaatcttccttacaggaaaatttcaaatagtatacgtagattcctattcccaggagatggagcttaatcctctcagatgctagtgtggattgggcttagtgacttcttcaaagaaaaaaatatggcaagggaaaaataataactttacagggagacgtcgagcaaccactcccttaaccaaatgaccaaagttaacattactagtgttaagtcatattggtgtcatatatcctctgatgggtgatgaaaagggtacttcacccctgtggtattccaaaaatagacccacgtatatatggaaaactgattttcaaaagtgcaaaaggcaattcagtttcaacaaacggtgctggaacaattggatttcaattggatatcacactctatataaaaattattacaaaatatattgtagacctaaaagtaaaatagaaagtcactcagctcttagaagaaaatgtaggggtaaatctttgtgatttggggttaggcaaagatttcttaggtatgataccataaacatgggcagtgacctaatttccaaataaagtcccacaggtatggaagttaagacttcagcatgtctttggagataacacaattcaacctgcaacaaatataatggttcccaattaggactgctttcatgtttaatacagagaaactgagaatctctatatgagtttagtgcttttcacatactacctaagaaatgcatcttccacatttacatttagtcttccaatgtgttggtgttgtcattaacaaaatacaaattctcctaaaaatattatgaattgtagctttgggcatttattcagtttgtggatagtataataattgctattatgtgtatccctgggttttgtttgtgtgtttgttttctactttcaacacaaatagggagagagtctctctcaccgatttcgtgccacactttgtcacttgggcattaaaataattttaccctggccctttgtcttacaaggtctgttgccaaaacaagcttcttcagcttctgctgctgtttccataaagatttgacatgagttcatggaattgatctcggggacgagtgtgtcctctcttttctgtttacctagtacccacagaaactcctgtcatttctagtccaaactcccacctggattccttactataaatgaattcatcccaaggaagaaatcaagggggagtatagaacttgggttacaaggatatttgttataacattctttattatgctgaaaaattagacccagcctaaatatttacaaaagggaacttcttaattaaatagccatatcacaggatactttgcagttatcaagaattatttagaactatgttttttaaatctttatctgatttggaagttcaatatatagaatgaataaaaaacaaagcagctctgatatgtgggaagtctagagccccatctacacactcccgctctgtgagggacctcttttaaacctctagaattttatagagcacagtttaaaaccagcactgtagtgaaatatttaatatgtaaacatatgttgatattttatgaagttaaagttgtcaatatgtccagtatgctttaatttttatgaaaataaattttaaacattgtatacagaaatctatctctattttgggaaagaatgggaatatatgcataacaatgctgggtgttgggattatgggtgatttttgtttactattttgtctttagtttttaaaagtttatacgtgtacttctttggacataaagaaagtgagacatttcttcatattgaaaaggcagagagaaccattgctttataggaaactacagtttggaaaaacggcagtctcattactcaatcccttgagagaggaattatcttgaaaatgttataaaaaatattagtaacagatttactagtgtcagtggtcttgtgtgttaagtatattaggataagccacatttgtaacagctaacggagaaaacataactgaatgtcagtgttacacagtgaactttgtagagcagtgattcccaattctgagatgttgtaagaggaatgtcagaattcctaaaacactcatcctccaacctttcaaattcagtgctgtggtgagccattgttactgataagggtatatcccacttgtgatttctttgttttgggtcaagaaaagcttttgtagaagccagtgtaaaatggcatgcatataattaatttcctcatcttttcctcataaaatcagaggtccttttatcgatggtggtttgaaagtctggggtattcagatttggcagcagaaagtgtgttttttttgtgtgtgtgtgataaactaggtggattgctaattctgattgaggaattcgtaatgtttgacaccagaaccagagcacttgtgaaaagaagtctctttagtacaaaaccaaaaatttaattacagcatttgttataactatagccaataaaagtatttttaatgaaaaagaatttccgcagaagaaaatgctttctattaatgcagaaggtgttatatagaagatttaattgtaatgatattggttatgatccgttttttgttttatctttacctgtattttatattcgtataacctctaaattttacaaattacccataatacatttcttatataattaaaaaaattctgagtacagaacaggaaatatgttcaatctttattccattagagttctacttggaaagtattaatatgtaaggtttttatttctccataagaaatagacctatatagtcaggcacagtgtctcatgcctgtaatcccagtgctttgggaggctgaggcttgaggattgcttgaggccaggagtttgagaccaacctgggcaacacagcaagacctggtctctacaaaaaaattcttaaaaaatttagctgggtgtggtggcatgctcctgtggtcctacctacttaggaggctaaggtaggaggattcccttgagcccaggagttcgaggttacagtgacctatgattgtgccactgcactccagcctgagtgagagagtgagacattgtctccaaaaaaaaaaaaaaaaaaaaaaaaaaaaaagaaaagaaagataaatagatctatgtctagttaattcgaggagatggtacacatttttagagcacatgagaacgaagtttatacttttctgattttctgggtttccttgatgattttttggcaaatccttgtctgtttagctgtctggcatatgtatgactgtggttgggcttctttgtactcaaccaatgaatgcataccaactgtaacacctgaaggtaggatcatgaataaatactctgtgatttggggttagtatagttttggttgttttcccttctcctgagatttcagaaataaaagattcctattcctgtgatttttttggcacacagtaagacatatttgatacataagataagtcattataattaacttgtcgaatcactttttcttgctgcagaatgatatttttatgaatgccttaggttttttcaataaaaaatgcaaccaaactgcaaatgtactgtgatttaaagtggtaatgtcagaatttaaattttgagtagtactctttttttaaatcatagaatgctctatgtttattcaaaaaagtaaaatattattagacagtattttttattttaattttgcatttaaataaagttctcaagctcagactgaaaagtaaacactgtatgttggagcctgtctcaacgacacttaaaagctaagactttctactttttcagaagtacatttgtatcttttggcaaatgtgtagaaagcagcctgtcctaacaaattttgttcacctgttctcacttcagtttatagattgttaaacatttaatcataatatattttatatacaatatttatgtgaaaaatgcccatccttgattaaggggatttttttctactcttatttttattatttttaccagtatattctgaagtagagaaatgtgaaatgagatgaagatttaaattcctagcaaacagaatcatgcattgcccctgttttataagtaatgagatcattttgtagagtccagtttatttacatttgttaaatgatattaatatctcttccataagcatgaatttggtggtttgcatggtgttcactgaggtgaggatacttgtttaagtattttgaggatctcatactttcctagcagttctttttacttggttttctgaagtgaatatagtctttaaaaaaaagtataaggtactagtaatcagatactcatgatcacaaatgaaagtggtggagaaaccttttaaggaatattcacaaaagtgataattttccagattgtcaatgaggaaatgaaagtctctaataagctgtcacattaattgtgagctgcatttctcagtcagcaacaactaatagtcaatctataatagctccagcagagggaatgaaagtaatttagaaaaaagtttactatttgatttgtcaaagtgtgtccaggaagtaagagagcctaaccaaggggctgttgtgcatgtaagctcttcagtaaaagtggtggtgtactaagctatatttaagaaggtaatttgagattttatattacatgctagtgaatcatttttggattttgcaccagaactgagctctttggtccctgcctgtctgtggtttgtgttgcaaggtccagaggcttaaaacaaagaacaccatgggaaattctccatgagtcattccgtcagctgtagcttctgttttatagtccttcggatataactagtgttttaatgccagctctcctagccgcttttcatgctttggttctatatgctaataaaaaagtatggcagtatggctattgtagataacgttcagacttttttttctcccgattccacaatttttagttcttctaatggctctaagctagaccaattataaattgtaactggtgaaaagatttatgactgtttattttgttgtagttgcgaggtaagcgagtggtcacttaatacttttggttctgtgaatcttactgtccagagaactaaagattgaattagcagttcagctggagtcagcactatgtgctaaatccctatacttaagagctcttatgtattgcagacaaatgtcctcttagctgttttgttattttgtgaaaaataataataatagagcaaggcagtttagattcatatcagtttcaaattttaagtaccatgttttaagccattctaattgttttgtagaaacagataaattaaaaacttgatttaaatccagcccacaggatgccttaatcacctttgatattttaaaggagatgaggaaataatggacttttttgctagtaagtggcaggtatggtcaacacaatttcactacatttgaaaaaaatcactttccctgcttgccaggaaaatttaaagtgcagattgtaacctgatcttttttcttacagtgtaacgtctgagaagttcaagtattgacatgaattttctatgataccacttggtaaattaaatctgtggtttcatcactggctttgaattatatatttctatgcattttacttagctaaaaacttatttgaatatttagtctttaaatttattttttcttttctgcttatttgaatacatatcaccaacattcagattttatttttgtttttcttaatagtaaatacataagtggttactgcttgctaggcaatgcttcttattttctaatttaatccccaaaacaaatttgtgaggtataggtagatgtattagtaattatgttttagaggagatgcttaaagaggttaagcaacttgttcaagttcaaatacctgttaaattatgaaactagaatattaacccagttacatttgtttctgaggagtcttttgcccccaaggccttgaaattttagggaattttcatttatagcaatcaataatactattcccatcccaccctgtccatttctgattttcaatagtatagtttctgcactgatatttacatcgtcttacgatggttgagccttaaaattacctgcattgttgtctgatttgcaattctttgtctagtaactcttctcactggagtgggttccaataaaatggtgctgtatttcactcaaaatcaagttgcagtgttttttcctcctcattttaacatcactaaaatcagagtgtatctactaatggaattcttgataattctaaatttaataggtaacattctttgactgctaataaaatcttaaccactatccaatgtaagaaaaatttgtttaaccatctccccttcatttcaaccattccttattaagaagaaccaactacagtctcaaatgctcctttataactaagcccagggaagacatatctaacaccctagaggagagagaaaagggtatgaattaaggtttgagtgtgatatcagcatttcttctcatatggcttcagaacacttctcactgaagtattgtcaaaaggctctttatgcactgaaatcaataaaagaaaaaaacaatttctagcaggctatttattataagcaaatatgtgacgacacaaaactttctggtcctttgcaattttttaagtccaaaagaaattctgtttaacaatattaaaggactattccagttacaaaattgtgtgtttgtgtatgcttattagaataattaaacttggttaaaatgtaagtcttactctagtatacattatttattgggtaagtgttatttaactaccaaatcacatttccctctacactgtaataacacatcgggaagggccacctagggctttaaaattagaactcagaatttaacaaggaaaaggtattctgagttgagtgaataaatgtattctgaacgtttaaggcctttggttaagatttctaaaatgtagctgtgcttaatatacaaaatcaaaagtaaaggcaggccaggcgcggcggctcacacctgtaatcccagcactttgggaggccaaggcaggctgatcacttgaggtcgggagttcaagatcagcctggccaacatggcgaaaccccgtctctactaaaaatacaaaaattagctgggcatggtggcacgcagctgtaaccccagctactcgggaggctgaggcaggagaagtgtttgaacccgggaggtggaggttacagtgagctgagatttcaccactgcactccagcctgggtgacaaagcgagacttaatcgaaaaaagaaaaggaaaaaaaaaaaaggcatctagccaccatatcccagtgattcaaattcctgataattctttgctttattaatcatcgttcttcattttggaatttgacttttttgctatctgttaatagaaaaatacacacacacacatataagtaaacacagtatattcattgttgaccaagtgtccaagttatcaatatgatattttcaaaaaccaggcacagtttcattaggcacctgtaacattatgtcatagtcacatacagctgttctacataatatcgatccaaaagatattgtcatgatttcatgattagactacacagtggacagggacttaaaaatataggagttttgttcaccagaatgtatttcatcagactaatggttgaactgatttgttgcttatgacctggccactttgtagctttcagacctgcctttctgtagcagttgatagtatggattatctgatcttccttcccttctgggacaggcttttctcttttctaattcattttcttaatctcctacctccattctcaatcatgcagatgctagtttctcccccatatttgagcctgagcattttttcaagtttccttggtgttttacatttcagtgaccatcagtaggttgataactcaaatctgcaactttagccccaggctttctttgaggttctagctttctatttccagctctctgattacatctgtctcaatattcagcatgtggtagggattttgcaaaactatgggattatcttggtgactttcctagctgaagcagagagaactaatgaaatagccaagaaggttcttgacattgttacttatgcatataagcatatatatacacacatatgtacacatatatttatttgctttagcagatactttaaagtagaattcaatgattagagaaaaaattatgattttaatattatttgagacgttcttaatctatacttgaagtagtaagtagattatgataagcaagttggactgtgggcgtggtccttgttcattttctcattccgtttttgtccccatttttcctctcctttttcattaccttgtaagagaaaatagctcaggaaacgggtttacaatcagtagtctgggaacttccgggattctttaccagcatccccctggatgttgcagtccctgacgcaagcagcattgttttagggtaggagtttttataatggctgtgaggtcgagtgcctaaggttgataaatggcagttgttatcctttgcagaaactcagttggaatcctttctgtcaacttgtatgttcatctgtaaattaagaaacatgttcccattccctccctctcctacctcaacagttatggacagactgcttaggaactcctatttctgaagatttcgtggtcttttgtaaagtcagtttgttctctagagcagtgtcatcttgtcccagaaccccctttacttactaccactacttctttgtaagttaacatgctatcactgattaggaaaggttttagattcttagtctttttctatggatcaattttggtttaaataggtgtcgaagggaattgtaagtcagcttgtattttggaggttttgtttctacctccatgccaaatgaaatgtagtcattgaagtatcattgtattatgtttatttctgtctttactaataggcttttttaaaaccctagttttactgatgttcttaataaagtacggttcctattactaaataatctttacataaaatgccataggttgaaataatttaaaagacagaaatcaaaatgtaggatgatatttgagaagacttagattagcatttatatatagcatcaaacgcttatcaagaagcttccggcagtattcatttaaaagagagagaaccaggaggaaatgctgtagttctttcagcttataggacccccccagaaaaacaaaacaggaaagtgccctttgttttctacttttggaaggtattttttgtaaccgataattactttaatgttaatttttttctagataatctgttattaaatctaaacctaataattgaggatcacgatgacatagatcaatagtgcagtaatcaacacccagatattttgggaagtagtgtgaagtgatgggaaggaaggaactttcccttctaggaaaacagtgagaataatattttaatggcaaaatatttctttttgtcttgatttttaaaaatctataaaatggaaagtatatctcttcatagagatttctttttttcaagattaaacgagataatacatgtggaaataatgcatagcatttggtaagccctttataaatttagcaattgctcttattattgggatttttaaaaagaaaagctatattctaggacagctgatggtaaatgcactggcagtttaagatttaacaaagtagttaagatacttaaacatggtgttcaacttcttattcctccagcttattgattcttgctattggaaagttaccataagatttaaatctcttattctggttcagtaggatgaataaatttagtaacaaaatcttacaagtaaagtaactacatctatccttattttttctttgtttcaggtttcccctcaaaaaacctataaggtaagtttgctcaattacacttcatactcaagtttaggttatattttaattataagcatccctttgaaattatggtggatttttgtggtttttgagaatgtgtattcaagtaattcaaaatttcaaaatgttttacaaatttaaaatgtaaaagatgttactttttctggaagacagcattgttttgataatacttctaatataagcatttaaaaattttgttcaaaaggatatttaaggtcacactgaagagacttaattttgaagtctatttgtgactgttttgaattatgagtagcttaggaggtgaaaatagaatgctagtttttgatgtgttttatcacttgtgtgactataattgcctttagttaatgtactttggtactagtttagtcttaattactttattttttattttattttattttattttttgagatgggatctcactctgttgcccagcctggagtgcagtggcgcgatctcagctcactgcaagcaccgcctcccgggttcacaccattctcctgcctcagcctcccgagtagctgggactacaggcgcccgccaccacgcctggctaattttttgtatttttagtagagacggagtttcactgtgttagccaggatggtctggatctcctgacctcgtgattcgcccgcctcaggctccgaaagtgctgggattacaggcgtaagccactgcacccagcctagtcttaattactttaagacagtgaagaaaaaaatccaaaatgttaaaatgtatctatgcctatatccatgtctatatatttattcatttccaggtcttaaatgcctcttcctcagtatttttgctttcagcatttcttctgttatcttatcataaatattatttaaaatgtaggtagtatgtcattcctaattattatattttatcatttttagtgtcagcatagtccaggatccaatgctaaccttggcatttcagtgaatatgtgtatgtgtacatatgtattattgttatggtcttgtcacccaaccattatctgatcagtgtaattggctaagccatagaagtaataataataataatgtcattggtccttaaagtggttggctaagacttctgtggctagaactacatcagcaggcttaaaatgaggcttgcctaaggctgctttttaaatgttaaaccgttctcatgcatgctctatttatgcagtgattttgaacttgatcatagtatatgtagagttggagaatgggtttaattccttttaggcactgtgttttttttgtctgttaaatggaaatgatagtattgacctgtgaaaaccacacaaaaaaaatgtaagcagttacttctgagaataaaagagactttaatgctgaatactatttttaattattttaagcagtttttataatcaagtaaatagactgtgtataaccaaaacttattgaaaaatgtaaattagagaggcttatggtgctgtgtaaagtaaactgatttcctggtttttcttgtaagatccacttttagaattttaaattttttattctaatgattttcttgcactaagcatttgattactttgctttaatttaggcatggaagtattttgaaccgagagtcaccaacagataagaagcagaaagttgagcgcattgcatcacatgattttgaccccacaggtaaaacactattcattctttcaaagagtattgagagtagtgaagttcagaataatagagcttaagctacccgaaacactcaggaatagttgtttgatctgttttaggactctcacattcctccaattatatcataataaagcctttgcatttagtaggaatgcaagcatttttaacttccaacactgtacattccactacagaagtatcattgtagagtatattgtatctttaaatagtgataataatagaaatggttatataataattggagatttggtcagatcaagaactcagtgttaagttgaatcatggtataagcagtaatatgtcataaaaccaaggctctaacaactcgacacttgcgtagtcatctaaaaattcaattgtgattatggtgaattggagttttagataaatcagtttcacaaattaatgatggtctcattttagagtaaacaaatgaatagaaatccctttctcttcagtcaaaaagtattctgaacttaaagagctgtctttcaacctaagcagtgtcgatctttcctagggttgtcaccttaacagactttcagattgatctccttttaaaacatctaggctttttccttttgctttctccttgtaagcttactccatatttgattcatagaaagtgcttggtaatcttgcttttttcatttgaaactgatatatattttttgtgcacatactattttattcagttgcctgtccctttgacaagagacgaagtaaatcccgctatctcagatacataaaaataatgtatctatttttaggtatttttacttagaaatataattttaaatatttaatagagaatagtatgttttatttatctaagacatttcatactttattagtataaactcctttattttgaaaaaatattataaatattatctaggaagcacatagataatcattttctgcattttgggtagtaggtaaaatgaaattccaatcatcaatttaggaggctttggtggtgggactatgtattatgtcacttacagatctccatgaagagagaattttccattctgatgcctaattttgtagtcatggggctcagaggctttcatttacatgattaggtattgtcttgccaataaggtcaaaagtttctgccctatgttcagaaaaatataatcttgttaggtttattttgtatctacatctgtgctgtgcccatctccaaagacagatttaagcaaagatgtatacaatgcttcataatgagatcattatagcttttagtgcttttgtcatctctacaattatcaggtgatatattttgtatactattcatgtgttgttttgtttgaacatatttttattgcactgtcttttcttcgataaatctttaaaatatgtcattacctgtgctgtttgtgactattctaagtgctgtcatctgttatgttcatactttgtgtttgcacgatttaacttgatcatgattcattcttttttccccatgaatttttccccttacattgtctccatattttctatatctctctccttttctcccgctcttgtgcagatagctcctccaagaagacaaagtctagttcagaggagagtagatccgagatatatggtaagctaatgtagctaattcagccttgccctttggagcttgcttcatggtgttccttttctgttctttttttcctttctttctttctttttaaataactgcagcctttcttgtgtctgctgtgcatggcatgatctactgcagggaaagggagcctggggttttaacgtggctgtgatgtggaagcttaaggttgctagaaactaacattgtagattaagagtaggccacattgcccatcttctcccgtcttgtttatggtaggaaggtgattatctctaatatgtttgggtcaggttcctccaaataacatgaatgggctttgaattcttgtcatcttcttcccacatctcatttgcagagtttggattatgaagaatttgaggaattaagtcttttcctctaagtataatactggtgtaatttagacgtattagcagttctttggaatttttatttcattttttgtttgtttatttttaattgcctcgtcatgtggaaaagtcattcttgtataatttatccacgatggcaaaaatacgtaagtattttatcttcatagcttgaagaatttgtgcctttgagaagtttctctgaagcttaatcggaatgggaaaatttcagaatggtaccttttaaataatcttaacaaagagcaagtttaacctgagtggtcaacttttgcagcagatgattgaaatgctaatatttctagactgtgtcctgtcttccaaagatacaataaccatgtttgtgaagttcatacctatttttccttttcctttgcagttttatttgccctctttccttcttttggagtctgattagggttttgttttggggtttttttttttttggttttttgttttttgagaaaagtgaataagagaggaattacctggagctaagattttaaaaataatttctgaaagactgataaattatttctttttttaggaagattccaaatttggcctcgaagggaaatcaggtcatctttaatagagccacaaatctatagagcagaagctcccccaggtgcagatagatgtttcctagcttgatatataggagaggaaaaaatacaggaattgccctcccctttttaagacatttgataattcacatctgctggcacttgagcccatatcagatactttttagtattatgaaagctcagtgtttggttctaaaccagttaattcttctatgttagatatatacacatagttctttacttgggtttttgtgaccagtgctttttctgtgtataccttttacagtagttcagcagtaaatgtatactgtgccttgtgacacatcaagtttacgctttttcttccttccagagtattttggctactgataagtaagaactacctaattcctggagactatatttctgttctatataaagagctttctatagtttatcctctccttaggaacatgaacattatctttatagctctattctttttcggtagcctttgcagtgttctatttcgtcttcctctccattttcctagatctgcgatgtgtatttagaagcttgttgtatgctttggatgaagactaacaatttaggaacctctgactagaaatactatactaatatttttcttagcagtgatagaaacattaatactagttcaggcatgccattggcttggtagtgatagaaacattttaagtggtaattgggaagtaaggtgtggcttctctgtgtgtttgttttttgagaacccttgaaataccttttttggaaggaactgagtccacaagtcctcaaaaagcactcatcggagggatgagttgattagaacagaattagcatgctaacgtaaatctctttgacattacaaatattttatcacctgtgtgaatagacgtctttagattacgtacagttagcatagatgaaaaagtctctctggggattcagaaaagcttgaaactactgagtagaatcatagcaactggtgacattctgctttagtgtagggtcttattataagcccacttcaaactttagagattatacattgctttctcggggtaaaattcattagctgagtacttaacaaaaatgctagttactcacatattatttattttaaactttcttggcttttttttttttttttttttttttttgagacaagatctcgctgtgtggcccaggatggagtataatggcgggatcatgactcactgcagcctcaacctcctgggctcaagtgatcctcctacctaagactccaaagtagctgggactacaggtgcacaccactgcacccagctgttttgtttgtttgtttgtttttttaatagagatgaggttgttgaaggaatgatttgccaggggaaaaaaaaaaaagaaagaaatagtagagacaaagtctcgccatgttgcccaggctgatctctgtctcctgagctcaagcagtcctcccaaaatgctgggattaaaggcataagccaccgcacctggcttcttagccatttttagagctactttgtgaactagatttactttgtgcatcttaaaaggaaaccaagtgtttgctttgtattgactttttttgttacatttctgcccagtgcggtcagttggttatttattccatttccccttatttgtccctttctacctgttagagtctattaaacgtgtatggatgcgttttctgatctacaattttaataatacttaattttattaatacttttgtgggttactgtaggaaatgagagattcagcaagggaattctgagttagaccatagctgctgcttaaccgctgtcatggtgtctgaacagattcctgctaacagtatttggttcaagaaaataagttatgtctttttaaagctgtcttagtgtgttcaggccactgtaacaaaataccatagactgcttggtttaagcaatagaaacttattttctcacagttctggaggttagaagatcaagatcaggatgtcagtgtgatcaggtcagaagattcccttgctggcttgcagatggctgccttcttgctgtttgtctcacatggcctttcctccgtgtttgccaatgccctttctttagtttctatgatattacatcaacctggttctttattctttgtaattattttgtctctctttatttgattgttttttccctcctgttttatacatgtaggcatgacccaagtttctgtccccaatctttcttccagtctccagtctaagtgtcccataaattcagagtgaccaaactggagttcatcattgttctctacagctggaaatcagtcttcctctttatttccctaattcttataatgacactgtcatttttccactcacctagtcttatatttccttaaagttatatttgacttctccattttccgtcgtcccctgtggtcagctatttgccaggtccccttgattctaccatcacaatatttttcatccttcactctttggtttcaaccccactgccttgtccatcattttattagactattataatagattcgtaacttacttttatttcagtttcacattgattcattaacttttctccattctatattctgccttgacttgtcagattaatattactaaagtaagaatttggtcattcacttgctaagaaagtacaggtagttattaagataatgccacaatttgtttccaatttattctactctgattctccttcagcgtttcattttccaaaacatgttttggcattcttcctttgcacatgccatttctgttgtcttgagtgaattaccacctataacttagaatcctactcatctttcaaggcttaattcaagtactgccttttcctaggattgcccagctacttttgttgtttctgaatgttgacatctgttttgtatttaattacttatatttatgtttatctttacatctcccataatgctgaacatattggagacactcattaagtgagttttgaatgaatgattgttgagattgacataggaagtattttagtagagaaaattgatggaataagatcttcactcatcctaattgaatctttctttccttctgaaaaacttgaagatagaagaaaatgtaacttggagacatttttctggtagtggtctgaaagaatgaaatcagcatacttggaatttaaggctcttcttgctggcaagactgtgcatttagaatcaagaagcttcttaatcaaaggattatctgaggtcttactcataaaacatgtatgtctggcaccagtttaaaatgagctgtttttatgaggttgcacatggcccttctccactcccttccctgaagctgattcttaagagctgaaacctagagaagtttggtcatgaaataaaataaaaggtgaagaaagactaatgtgctttcactaaagtcaatgtaatatggaagatttaacaggttatcttacatgtttaacactccattttcattaatatgccccacaccctattttcattataggagttatggccttctttcaggaacagttatagaatgacacttcatttttttttcactttcaaaatatgatcattggtaattatctattgagtaagaaggaagcagtctttttatgttggttttaagtgccacattgtaataacagaaaaaatatgtcttttgttatgataaggaaataaaagaaatggatagtatttatgtaaatttgatataacatctttacttcactgatgagatgaagcatgatatcaggtttatcagcttctaggcaaaatatgatttttaagagacaggaaataaagtttgttttgtaactagaggagttattttggggtagatggaaaaatcaaattattatagttggaattttgccagggcagaaggttaattagcgttcttatagaaatgttcctctactttgcatagtcttcaaggctgtgattttttttctaattagaaaatgtttgagtattttatttaaaatttcctttgtgtataaaattcaaatttatttaataactatttagtgagcacccattacatgccaggcactatactaaggcatagagatacaaagatataagtgactctacctactttctggttgttcacagtctggtacaaaagaattgcaatacattttgataagtgcagtgatagagatatgcactcatttaccattactctatatgcacttaaaaaaacagctgtgaagaaatactcatatggcaccaagaacaatgggacggaagaagtattactaggactaagtcttttgtttttttgaaaaacgtgtttattattactgttattttttgtagagaagaggtcttgctaagttgcccaggctgtgctcaaactcctggcctcaaccagtcctcttgccttggcctcccaaaacgttgggattacaggtgtgatccacggtgcctgcctgtcaggattacgtttgaaggaagtttaactttttataccagtctcactggttttactttttgaacactctgcctgtgtctatgcaaagtgctggcatatagcacatatcaaagtaattaggtggccttacagaactcatattcacagatagatacatttgtatggaagttatgattaataatctttataccagatgataaaggatttagcaacaaaacaaaaccatggactatatgagttgtagaaatcagaaaaagtaaaagtgatgaaagctggtttttgggtttttttttaattaatgaaatttgaagattgctattttggagttatgagtctacttttatctttggctttctctgtaacatacagggcctattttctgtaccattttctgattcttaaacattgtcatttttttctccatttgttttcagtattgtcctgccaggattttatgttctttgagaacagaaactccaagtagtcttgggttcttcacagcacctatgaactgcagtgttaaataactagtatggacagatgctcaatgcaaatttgctaaaacaaacaaaagaagtaggatttttgtgtgtgtatgtcaaaaaggatagtacaaagatatgataatgtagccagtattggtgattttagttctacagagggtggaatttttccctctgtggtaggttaaaacagcttctggtcaacaaatagaatatttctctgaagaaaaagggaaaacatttcatttgattttgaatgagagggaacataatagatttgagcatttgaaggactggatttctgaattttgaatggtaggatggcttcgttttcagttaattattaccacagatctaaatttatgcagacaccacagatagacaggacagaatagtattgttaatttgaattttatagattctgaattgactgtatgtgtaacactttttatattggtctactgatttaaagtacatgttaaagtacatcaatctcacattagcaggtaaatataaaataataaatgtggctaatacagtggatttggggagaagaaaaaattgaataggatgtgtgcatagttctttttccttttcctctttattctttgtccctcatctccttttgctgtagaattaagagggaaggttatcagactgagactgttatgaattggagataagagatttgctgtattctgaagtaatactaataggttttcttgattcttattaatctgttaggattctaggcatatttataaaattgactgtgcatggtgctgtttttttctctccgatgacctccctttctgagcttcctttcatctctagacttgtctacttgtctgaatttcattaattcataagcaatttttttaagtttccttctgtcccagaatacatgcaaggttctgagataagattgtgatgaagatacagcccctgcacctttggagcataaaatccaatgaaagaataaaaacaaatacaaatcagtgtgagtaagggtgatacagtaggagtacacagagggtgcagtgggagtctgtaagaggggcacctaacttcagtatgcatatttaggaaaagcttgtaagaagactgattcttttcttaaggacgtccagctgtctctcatcttctaaagctgcctataacaagaagctctgcccttttaaatttcccttctgtcttccttacccatccaaaactactttccttgtttgctaaaaaacaaaacttagacataaatcataattgatcctcttttttttttgagatggagtctttgttgccaggctggagtgcagtggcgcgatctcggctcactgcatcctctgcctcctgggttcaagcgattctcctgcctcagcctcctgagtagcctgggactacaggcacgcgccaccacgcacagctagtttttgtatttttagtagggacagggtttcaccatgttggccaggatggtctcaatctcttgacttcgtgatccgcccatctcagccttccaaatgcgcccagccagaattgattctcttaaggatcatttgcattaattgataggagtttattaacataaaagtacttacaattgtactagtagcatggatagaggagaaaatccaaggtcaacctccccttaatcataataaaataatatttaacgtgtaggaacccttaatatttgttagacattaagctaactactttatatatttttttattcaagtgagaggtgcaaacatagcaaactccttgactccaaatacccgtttccctcatgttttacaggtgtcctgttctctgcaggcatctgaaaaaaggtctatttaagaagcccaggttgcttagcactgcagtcacccatattagaaacctttaattcattaattttcagcttttgtgaggtgaggtgggagaatggagaagcacgaatatagtatgaaaaaacgtattcagtgttataattgccttgatttctaaagtcacagtatctaatttattttgaaatttcaaataactataagggaggttgtgaaatatttgtttccaaaagcaagcatggattttaaaaggttcctgtaaaatgctgcttagtctaataattttttttttttttttttttgagatggagtctctcactctgtcacccaggctaggctggagtgcagtggtgcagtctcggctcactgcaacctccagctcccagattcaagcagttctcctgcctcagcctcccaagtagctgagattacaggtacctaccaccatgccaggctgattttgttttatcatgttggtcaggctggtctcactcctgacttcattcaggtgatccacctgtctcagcctaccaaagtgctgagattacaggcatgagccaccatgcctggccagaatctctgattctatttattatatgctagaatttataaagaatgctttttttaaacttgatttatatattcatatcctattttataggtgtcctaattacttgaaggaagtaacactgaacagataacaaaggttgaattctaatgtgttatcacctgacctcattacaatttattgttttgtgagagtggtgaatatgttatttagtatttagaagtctctagaatttaggggtaacacatttttaaatgttgaaaatcaactttattgaggtaaaatttacataaaataagatgcactaattgtaagtgtatggttagaaaattttgacaaatgactatgcatactcatgtaaacattatcttaagaaacagaacatttccatcactgcagaaagttccttcatttcattttgcagtcattcccactcctcttccgtgcttctcccctaggcagttgctattctgctttttgttgttttagtttagtttttccttttctatgttggagtcatgtagtgtttactttcttacatactggtttcttttgcttaccatgatgtttttatgtttcatccatgtttgttgtatgagtagtccttttcttccttcctaatacattgtatggacatacgacagtttgtttatccattcatccgttgatagacatttgagtttctagttttgggctcttatgaataaaactgctgtgaacatttgtgtatgtctttctgtggacacaaattgttctttctcttcagagtaaaattaatggatcatatgcaaatatatgcttacctttataagaaatttccaaacagttttccagaatgttagcacattcccaccagcaatgttataatgttctaagagttctagttgctccacctctttgctaccactgtttatgattagccagactagttggtgtatagtggtatctcattgtggttttaatttgtattttcctgacgactgcagctgttaagcacctttacatgtgcttattggccattggtctatctttgtaatgtgtttatttaagtattttgccccctttaacatttgtcttccattattggctggagagttgcatataatctggatacaaattctttatcagatatccatattgtgaatattttctctgtggtttgccttttcattttctttttctttttctttctttttttttgtgacagagtctcgctctgtcgcccaggctggacccgcctcccaggttggacccgcctcccaggttcacgccattcttctgcctcagcctcccgagtagctgggactacaggcacccgccaccacgttcggctaatttttttgtatttttagtagagacagggtttcactgtgttagccaggatggtctcgatctcctgacctcatgatccgcccttctcggcctcccaaagtgctgcgattacaggcccggcctgccttttcattttcttaccagtgtctttagaatagcaaatgttttaaatttttgtccagtttcctaggttttttttcttttatggtttataaacccaccctaaggtctttttttaatgttataaaatattttgttacatgtattttatctgttttctttttctttctttcttccttttttgtttttttaataccctaaggtcttgacgatttccttttgtgttatcttatgaaaaattttagcttatgtttaggcccatgatctgctttaatttttgtgtaggtcatgagttcaagggttaaggttcatgttaagctacagtaggctcatgtactcatgatgtgtcattatcagcaaaaatagatatgtatatacactgtgtgtatatatatataatttgttatatgtatatgttttctatgagccattgtacacacagtctatatatattttttattaacatatctttagcatatcgtttggttggtaaatcagacttatatttaaaagattgtggctttttgtataaaaatctttagaaaaagtttttattttctattcattatctttgtgttgttttacctgttttatatattgacttcggtgaaatgcttagatcctgcaaagctgaaaatatatgttgtctctggctaacacagagttcaagatcttcagatctggtctatgataaaacagccctgggtactaatcagggttctaccctggcaggacatttctattcctctggctggggccctctttctctcaccttgccctgacagttttcatttgctgtttagaagaaacacaaattctcccttaggaatcaggtaagtatatgaaagagatgaaggaactggttgagctcacagattctttatcttttctatttttttctcttttctgtttctgttttctataagccagggtttttcttccccctgaactcttcctttctcttcccttctttggggaataacttcaggtactctgtaagcacctcctttctttttactgttttcctgagtatattttcttgagagtgagactggatttctgcagaattttccttgagatgctcctagccccatgtcctaagatggttgatttttcttgggttaaacaccaattagggtaccaaaaactcagggcagtggggcagggggagaatttttttactacagagaaatagcatggatgtgaatgggctttccttctagctgtctcatgtctaatacttaatattttgcagtttgccatagctgtttttaatattggagcaattctattatactccgccagtgagaaaacagtatgtgtgactctgtggtgttcttgtgtttgctttgttgatggtggttagtgttcttattttaccatgtggatttacatgtgctactttttgtttctccagatggaacacagtttattactaatatataattattgtcttttcctttctctgttttctcttccttcttgttttacactgtggttcttgtgcaggtcttgttcagcgttgcgtaatcatccagaaagatgacaatggatttgggctgacggtcagtggagacaatccagtcttcgtacagtctgtcaaagaaggcaaggcattttaaaaaacaatttatcactcagtaaacagagtaagaatagaaaagcttaaataatggcaattgccaagaatagaataattacatagattgcaggtcatgtggactattgtgctagattcgtctatcatgtcatagttacaggaaggagtttactccagttgatttttttttgtacttgttagaaagaaatcagtttttatttagttttagaaatcatgtgactccttggtcatgatactttattgtccacacaaaagtttctgaaatttcagttttccatggcaccactgatattttggcaaagacagattaaagagatagctatggcttcagaaataccatttattttcccaaaacaacagtgataatattttctactgctgttaccatatattgaatacttcctttatgttgggtgctataattttgaggtagacaatttttttatccccattttataggtgatattgaggcttagagtaaagaaacatcaaatcagtccaaggtcacacaactagtgagtggcagaagcagcatttgaatgtaaagtctgactttacagccttgttttttttttttgtttttttttttttggagatggagtctccctctgtcaccagactggagtgcagtggcacaatctaggctcactgcaacctctgcctcctgggttaaagcgactctcctgcctcagcctgccgagcagctgggactacaggcacgtgccaccacacccagtgaatttttgtatttttagtagagacggggttttaccatgttggccaggatggtctcgatctcttgacctcgtgatccgcccgcctcggcctcccaaaggacagcccatgtttttaaccagtttgttatactgtctctctgtcaggaagatgatcagtaaatgcaaatgaatcacattttaagcaattaatttctcatacagatggagcagccatgcgggctggagtacagacaggtgatcgaatcatcaaggtaaggaataggctattatagaatttacggtaggattaaaaaacaacatatattggtcatattctgatttttttcacttggatttttataaaaagcatcatacttctatgtatgatagatctgttgactatacaaacttatttcatttgttttaaaattaatactaccctttactgaaggacgtaataaaaggattgaaaataatggaggaatatatgttcttgagtaggagagtaattcagggttggaaagatcatttctgtctagattagtctgttattaagcaattctcatcaaagtacaagttgaacatttctaatctgacacctgaaatgctcccaactctgcaagtttttgagtaccaacatgacaccatgaatggaaaatttcacacctgacctcatgtgatgggtcacagtcaaaagttggtttcaccaggtacagtagcttgagcctgtattaccagctactcaggaggctgaggtgggaggattgcttgagtgcaggagctgagactgcagtgcactttgatcatacctgagaatagccacagcacttcaacctgggcaatatagtgagaccctgtctttacaaaacaaataaaaccaaaccaaaacaaaaaacttggttccatgcacaaaagtatttaaaatgtataaaactaccttcaggctatgtgtataaggtatatatgaaacataaaaggctcatatttaaacctgggtctgatccccaagatgtatcattatgtatatacaaatattccaaacttcaaaaaaatccaaaacacttcttctggtaccaggtatttcagataagcgatacctgacctgtatgcaaatagaattgtagtggtagatgtctatctgattattcttccagatgaactttataaagatataagaatcactaaagataaaaacatgttatatgtatgtgtatgtatgagaagagatgtatatgactctaatctagatatagacctaccagtggaacacaacagagagactagaaatagattttgaattcagatcagtagagaaagaatgggttagttagtaactattctttaaataattgactaatttgattacttaaaatcaaattattacataagaaaacataccatgaaaaataatttggaagaaatatctgaaacgtatcacagaccagatatccttaaatttaaagaacacttttaaattataagaaaggaataaatattctaaaagaaaaatgggcaaagaattttatcaggcagttccctaaagtaactgaaatacataacatattaatgaggatatggccaacctcactgataacaaagaagaagaaattaaaatgataggtgaaaaatacatttggctgtcagaaaatttaaagattggtaatacacatttagtatagtttgggtatggtaaaatgactattctcatgagttcgttgtgagtataaattaggtaaaacctgtttggatgaaagtctgtgaatatgtatcaaaagcctttaagaaagtatataacatgtgacaagcaattttgcttttaggaacttatctgaggaaataagtgtacaaatgtgaagtcgtgtgtacagggaaatttgtactggctttattacataactgtgcataaactgagggacagagaaataaattatattccatttgcagcttttgaaaagaatggattaggtcagtgtgtatctttattgaaagatagctgccgtacagtgaaaaaaaagttttattttttttttccaggaaaaagccagtcgtaatgtataatgtttatgtgtctctttggtgtgtgtatactagaaaagtgtctccaaaattaaatgtcatagctaacagtaactgcctcatggggcaggatgagtatacttgtacttctgttttttacactgatatatttgtattttagataacttggatcagagaattaatcagaaaattaatgttaaatccacatttgatagttttgccttgatttgtttggtttaattcagaatcgggataacattttctacatttagccggtctgaaaattaattttctttgtgaagattagatcatggttgaaaaactaaaagcaaattgaatattgtggaaatacttattttaaaaattattttttattattaattttgacaaattgatgacttggtaattaaaagcaaagagatcttttctatttgtatgagcccttcaccgtgaacgatttgtaaatctgtttcatgttatgttttgtcatttgtcatggtgaataagttgtactgttttgtatgtcaaggcctcggtttatgtttaagttcattttgttgctgaatatgccctgtagaatcatggtgtgaaaatgaatattgaatcaaatacataaatattttaatgtaatgtgattactatattatattggttatattatgtatgataattcttgaagtcattttatccattgtctcaatagaatgtatctgacatacactactttcgttttcttacaggtgaatggaactctggtgactcattcaaatcatctggaggtggtgaagctaatcaaatgtaggtgaatgttattcttagttttaattgttttctgaaacccttaaagtaaggagcagcaaatttcctgtaataggccaaatagtaaatatttaggctatgtggactatatagtctactgccgactctgtcattgtatcatgaaagcagccatagactatatgtaaatgaatgggtgtggctgagcttcagtaaaactttatttgccaaaagtctgtgatcctggtttagccccttggctggagtttgctgatccctgcattgaaggaaaatctgaggtgaaaactcttagcttactaatagctatcttttgtcaactccatttatatggttgattataatattcctgtcattcttggtaatatttgatacatatatttgaaagaaatgcatgagtcacctgagaggaaggaggttgagaagtcagacatatggcctgatgaactgaaatggaactttaaaaatcatctagcacaatcactttccctcagataagtaaatgattatataatccagagtagcgatcttctcttggaaatctttagggttaagaatttgtgatcttcaggtttgagtgaatagcccacttggacttagttctctgtggagaaacaggcttgaagcagtgggagtctgcagctaacctcccgtcacttgcagggtcaaaggtggattcacgaacctcgagctggcagtgagttatgggcaagccaggcctcagccactcacagggcctcagttttcccatctgcacagggagaagggaaggttcagtggccctgtgagctttgctagcaggtggtgatggggtgggtcatctgaatctgagtcaggtggaatcttccccaacctgggctttggtttcattttgttgttatcctttaaccttacctgctttccaagagagattttatgttttcttggttttttttttttttttgtttgtttgtttttagggtagggtcttgtagaatgcaatggtgcaattatagctcactacagcctccaacttctgggttcaagtgatcctcccaccttgttttttgttttttgttttgtcttgtttttttggtagagacagggttttgctgtgttccccaggctgctgtcaaactcctgggctcacccatctcagcctcctaaagcgctgggattacaggcacgagccactatacctggccaagattttatattttctaattgcttcacatactgaatggaaaatagcatgacagttataacagaagtaaagaaagtcacatgagagtccaccacctaaaatataacttcctttttctttgttctggcctggtttgggccgtatgtatttgttattgtatctcttaaaaaaaaaaaaaaaaagagagagactgcttgaactgaatgaaatttttttaaaaaaggaattaaaaaaagaatttatgatcttctgcatcagattattccacagtaaagtagactagaaataagagatagttgtttgtgatcaatcagaatcactactgttttatttaattctgtttctctgtattgggtggatggacatcttcaaaagaaatttaataaactaacttttttcttggcctttttactgctatgttaagcaactatgaaattttttaaactttttcatcagagtaccagtgctccaaatggtcactttgatcagcgttctttagtttaaaagagtgcagtgatcaaaattagatccccatacttgaataaacttgaccacttatttaatgagaatgtgatttataaattgttatgtgctgcataaatatggtttatgttaatgagtttatgcctgatgtccattgaggtgtataaaaacatttctttagctttctaggttatattttttgctcattccagtataaattttacttaaaaaattaaatcctgggattctagcaataaattacttacccaatagtaagggcatagctaaaaacttaaagtaaagcataaaaacctctgcatatccaaaactgatgtaaatttgacatcacatctgtaaagcctgggtgtatgtaacagagttcctgcatgtcctactttctaatgtgtattctggatataataaaagtgatatcaaatcagagcagtttagaaacagctaaagaaaggaagggaaaagctaggaagctattaaaaccaaatacataggcaagtgagatataatagatgactttctgatagagagcaataagattgaagagccttagaaagtgtttatatgtaaaattcctccaaattataacacttgtgagtattatacatagcaaaactagtttttagaacaccaaaacactgtgaaataattgataatgatttccatgggagggttaaattgggagacaagtgtgaaatacatttaaaagttctattgaaatatctaagaaaaaagttttgccatatctattactgactctgattatggtgtttttttttgtttttgtttttgtttttgttttttgagacgaattcttgttctgtcacccaggctggcgtgcagtggcgcaatctcggctcactgcaacctccgcctcccaggttcaagtgattctcctgcctcagcttccctagtagctgagactacaggcatgtgccaccacgcccggctaattttttgtatttttagtagagactgggtttcaccatgttagcaaggctggtcttgatctcctgaacttgtgatctgcctgcctcagcctcccaaagtgctgagattacaggcatgagccaccatgcctggcctgattatggtgatttttgctgtctagattcccgccccccgcaatatgtctactgaattcctgtccattcctccaaatattttctactaaaatttactacttattattgattgtgtttttccctgttattgtggaatattttttggtcatactcattttgtaaagttaatttaaaattgcattttatgttctagcatattcactaaaccctgcctagttagtgtcatcttaaaatatgaagatctaggccaggtgctgtgtctcacacctctaatcctagcaccttgggaggccaaggcgggtggatcgcttgagctcaggagtttaagaccagcctgggcaacatggcgaaaccctatctttaaaaaaaaaaaacattgcagctacttgtgggggctgaggagggaggattgcttgaacccaggaagtcgaggctgcagtgagctgagatcgtgccgcggcactccagcctgggtgacaaagtgagaccctaattaaaaaaaaaaaagaagatttaaaaaatttacatttaagaaattaattaaacatagccactaatagatggttgattttaacactcctctaaataaagaaaatatataatatattcttggagttataaattttatttgcttttaagtaatatctgatcttactagtagtaacttgctatctgaaaacggcatcattcttttggatttttagggcagtcataaaagagaaatgacaaattagtttttttttctgtggagacatgatgtagcagatgatgggactgtcttacataactggatcttttagaactatcgaagattaagtagtaaaatggtataaaaagtttcttgacaatgttattttcccttcccttccctttttccgtctccccaccccaagctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggtaagaatggggaaatttcttagttaaatgctcagtcttataaggatgtgtttactttatatggagagttttcaagtattcggctgatgaactaattaaatttaagattttagaaaatgatttactaatataaaaattacataataggaatgattagaatattgtcatagcagatttaatttaacaagtattagacacctgccatatgtaaaacagtgtgccacccacagaaatatagttaaggtactctatgttcaagattatagtcatcttagaatgtgtacttttaggagggcggggatttttgtttattttgtttactgttacgtttccagtacctgaaatattgcttagcatgtagaaggtgcttaacaaagctttgttgattgagattaagtcaagagtatacaagtaactataatacaaggcagaatgtagacattatgagggcaaaaaaaatgctaagttctatgaggattcaaaggagggagaaagcacatagaagaagaacaataaatagaaggagccaaaaaagcatcaaatattgtggagaagtagctaggatttttggttggttggtgcctgttaaggatgtgcatagtgggagatgaacttgaaaatagtaggttgactatatattttgaaaagtcacatctcccaagctaatttacatgtaactagataagcagtaagaatccattcaatgttgtttctttttaagcaaaagagtacatgattatcctaggattataggaagactaatttggtaaaatattatagggttgtgaaacaaggagggatgatgggtgatgaattagggagctgtcttcatatttcaggtaagaggtactgggagtttgagctatgcatggggatcgatagtaaagatccaaatgagggaaagtaaaagatactattcttatactaagacaacttcatttctccaatatcaatatttagtgttctcttgaatccagtttagtaaaaatgaaatagaagggcagacatttccttgtagtttcttgtaagtgtcatgtctgaaagcctgtccacataacccggaagtaaaaacctaataggtattgataattggagccgaggcagaactttgtatgccacattttctctatttattttagcttcattttgtctatactggttgttgtttgttttttatctttttcttttctaggaggaaaacaatgtggttcataaccagaaagtagaaattctgagaaaaatgttacagaaagaacaggaacggctacaggtattaaatgagaagtagggctgtttacaggccaataaaaatgtgagtgggcatggttgagttggtgtttatcagtcacaatcaagcagcattgtaaccaatgccattagttatattattgattaagaatggactatttctgtatcttttttacataagtaattaattctgaaaatatttttataacttttcagttattgcaggaagattacaaccgaacacctgcccaaagattgctaaaagagatccaagaggccaagaaacacattcctcagctgcaagagcagttatccaaagccacaggctctgctcaggtagcatcactattacaagtgctacccaactttttgcaggagaattttcttctgggaatgtgtcagagaatgttgcagttgccttttttaaagttatttttctagcgtaggacaacaggatgtcctgttaaggatgttacagaagtaatgattaacaaaaataaatgtgggcgtctgattgtttgcttgctcatgagatcacatttctttgttccataataatttaaaaaagaattgagtgcttttgctttgatgtgacaaactactaaaatgtatttagatatatatatatatttatattttttgtggttcattctgccatcttaaaacagaatggcagttgatatgtttttaaataggaatttaagaatttacaacaacaggcattgagctaaatatatggacaagcattttcttatttaatctgcataacatctctgaggttacttatggttgttttcctccagtttacatatatacttagagagagttagagagattaaatgacttgtctgaggtcatatagctgcaaagtaatagaactggaattcaaacccagtctgaggatttaaaagcacattcatactcttaatgactatatttttattgtaatttaaaaatagatttcagtagaatttgctgtatagttataagctatagagataatggtctcataagaaaaaaaaagctcagcatttatatgttaaccagacttacattctgtaatattcagatttgggatatgtaaagcaccttgtacttcatcttaaagcaaagtagataaattgcctatacatttaaaataggtaaaagctgtttttttgtcactgttcccgagttaaatctgaagggaaggctgcatattcgcaaaagaattctttgagatcatctagcctaatctgcttactttctgatttaaaaaaattatgttataattgagaaacctagggtctaaactggttaaatcacctatacaaggccatacagtatgtaaggtcccctgacatcctggtttagtgtacttttcattccattgtttttttcattaccttcagtcccagtagcgatgtcacattttgagtgttacacctcagtaatgttgacagttttatgttattactaggcaaatataatattcttaccctgtttggacagcaatctaaatgcttataacctggccaggcgcagtggctcacacctgtaatcccagcactttgggaggccgaggcgggcagatcatctgaggtcgggagtttgagaccatcctggccaacatggtgaaactccgactctactaaaaataaaaaaattagacaagcttggtggtgcatgcctgtaatcccagctactcgggaggctgaggcaggagaatggcttgaaccatggaggcggaggttacagtgagccgagatcctgccactacactccagcctgggtgacagagcaagactccatctcaaattaaataaataaataaatgcttataacctgatctaaatgcttataataatttatgttatagtattatgtcctagaattggccattgattgacactctgaagcattggaaggtagttaacaagaaactatagggtaataacctttattaatgggcagacaatataaattatataaatataaattacataaattaacaaaccattttatctttttgctatatttagaagtttgaacttacattctttttaccaaaatatcacttgccctgtctttaaggtcatgacattttagaataccggaattagtagttatttatggattttactcgtagaattttaaacatacttgagcatatcagaatgtccaacttttagtagtctccatgtagattgtagtaccactatttctttatgcagcaagtaatgaaagttttcttttatgtgtttgtgtgcgcgtgtttttctttcatctgttttaggatggagctgtagttacaccctccagacctttaggggacaccctaacagtcagtgaggcagaaacagatcctggagatgtactgggcaggactgactgtagcagtggagatgcttctcggcccagtagtgacaatgcagatgtaagctttcagttttctaaatcttttttcttctgtattcttctttacagcccctttctagatttgattttaagtgatgtgaattagaggtgtcttagcactttttaccatccccatttttaatgtaccaatttgataaacagaaatctggttactgttatatataagcttttaattccagagttcactttttcccttgaacacccattgccaactgtttcttttacagggatggaatttcccagcaggcatcttgttcgtgggtagagaagttactaatgccagtgcatttttactgaaccgagagaccaactgttgatatctttaagagcatgttaatattccatttgtggtcagagtgactcagtcttgaatcatggggcactttgccattaccaagaggaaaaacctcagtcctgttagataggcttcagttaatagcccaggtttagtgacagcactttcttgattaacccagaaactgccagatgaacatgactatctgttaagatgataataaaacattttaagctgaatatgatgtaacaccatagacatatgaatacctaaaagctaagttcagtattacttacccagcaatactttgtaaattgtatgcagtggtaggaataatgacttaaatgtagatcaccctctttaaaagtgatgagggaagaagtctgaacgaatgttttgtaattgtgggtcatgaaatcaattttgtgggttgtatttcttttttaaaaaaagaataggaaatacagtgctttgcatatagaagaggtgtcacttcttgggacttttgttacatatacacacatctactatttaacaatgtgaagtttctctcttattgaaggttgttgttgggggattgttttgttttgttgttttttaaaaaggaagccgtggtctaagccatcattcaggctatctcttgaggcttaggcccaatgacccagttcctcatgcaaaaaacaaactgaggatttgtgggttttttgttttgttttgttttgttttttaaggtagtgataggagtcttgtgattgggttagctaaaggttttaatggaaaatttcaatttgggctcaaggaaaaaatggtagtcactaatatttgttgggtatatgtcccatacacggtgataaggttttatgttccttagttaattctcaaaacagccttatgaagtagtactgttgttactgtaactttacaaaagaaaaaattgaggccaaagggagttaactaactttccaaacttattcaggcaataggtgatctacttccacctagctccaaaataccagtaatcgaaatataaacaaaagcactgaggtttgaaaatgcgtaacattttgagagagcagtgagaattttagggcaacctggcatattagggttatagatggaatggctagagattatcttagaagccaaatcatgaatccaggttataaagggcttcaacttgttctagcagtacataccgcttttgggaatgcttttcgtactcttctttttgttttagtaatgcgtctcctcgctgttttcatggcttgtccctaccatgagatgggaagttccttgagagcagagggactgtcttgtctgactttatgtttccaaagtgtagcaaattgtaggcattcagagcaaatgatacgaatgagaaatttgaattttatcttgtatttagaggaatgttacaataaaacatgtgacttagaaatataaccttataaaagagtgaattgttggctgggcgccgtggatcacgcctgtaatcccagcactttgggaggccaaggcaggccagtcacaaggtcaggagttcaaaaccagcctggccaacatagtgaaaccccgtctctactaaaaatacaaaaaaaaattaactgggtgtggtggcacacgcctgtaatctcagctactgcagagtctgaggcaggagaactgcttgaaccagggaggcggaggttgcagtgagccaagatcgcgccattgcactccagcatgggtgacagagcaagactccatctcaggggtgggtaaaaaaaaaagagtgaattgtttagtatagaaataggcattccaatcaattaagactgtttgacatgtaattgatacttagtatttgaatacatgaaatcaatgaataaagtgggctttatcttgcatgcagaagagagacaccatcagaaacatatctgtggaaaatgatttggtgtaaagagggagatctgtaagaaaagaagactgcttggcttaataggaactttaacaaatgtgtgctgaatggataatagttagcatttattcagtacctactttgtgccagaggttgtacccaatgctttacagatactcttttttaacactcataataatcttaaaaaagcagtatcaccatttcatagatgaggaaactgaggccaaataaataaatgaatattgtggaaatccgagtgagaaatgataaagtccaagctaggctatcttctgaacacagaacacacaggtttaatttctacaagtgtctgaggctaaagatgtgttgcttttagcttatggatttccatgtttgtttcaattttaagtatggaggacccggtctgcttttgttgttgttttaacagtactttgagtcgcggttttacattttatcttttgaatcagtgcttttaacttttttcattgtcttctcatttttataaaataatttcctggtggtgtttgtgaaagttccctgcttttgcttaccttggagaaggctttaaagaatgccctgatacccagttctcacaagagaagcaacttggtaacaaatcatcatctgaaattcagagcatctatcattttgattttcagtttgtgagtgatatttttgaaaaattatttattttggaaaattgttaaacatattcaaaagtaaagactaacataatcctcctcatgtccctgagaacctagtctcagcagttttgtttgtaccccctattcctcacatcctccaaacaccagattaaagtaaatccaaggcattcgtttattaatatgtctctctctaagagataagaagtttttaaaatatagctataatattcttattaaatcctaagaattaatattttctcaatacacaattttattaccttgttttataatgatctttttacagtttatttgattcaggatccagtcaaggctttcatattgccattggttaataagtcattttaagtctttataatttataatagtttccttcttttttttccttggccatttgttgttgtggttgttgttaaagaaattgagtcagatgttcagtaaaacaatccattttctaattatattttcatggtgtcgtatgacatgttcctttatctaaattttcttaaaactcctagttaaatctacaagtcttgatcacattaggtttgatagttgttatttggaataattcatagatgatactatgtacatctcattatatcacatgaggatgtgaatggctgtcttactgtggttgtaagcttaaggtgtttaggtgatatcaacatgatttccttcattataacgtcccctgtcaagcttttttttttttttttttttgagatggagtctcgctctgttgcccaggctggagtgcagtgacgcaatctcagctcactgcaacctccgcctcccgggttcgtgccattctcctgcctcagccttccgagtagctgggactacaggtgtctgctaccatgcccggctaattttttttgtatttttaatagagacagggtttcaccgtgttagccaggatggtctcgatctcctgacctcgtgatccacccgcctcagcctcccaaagtgctgggattacaggtgtgatccaccactcccggcccccaagcttttgtgaaatgttttcacatgccatttatgatcaaaatgcctagatccattgtttaattcagagtttcaaaaggatattattataattttgtcagtatttctgtatttattacatggagttatgttacaaaaaatgatttcccttactagctaataggttaccctaaaatacagcttatacagaaaatgtagggtaaatacttctcttgattcttttcagaagagttttttcaggagagatgatactcttacaaactccaaaggtgacaagtgggaagggtatatgtgtgtaatattttgaactcatagatttcagtatgagttactcttttcttttgttggtgggagccccctcaaattttctcctgtgttcttttgacatgcccctccaatatctttgatagctttcttgctttttgtgacagaattattctaatcttttatatatcttgtccaagacctgaaagtcattcatttctccaaggtggggcatacatttgaaagtgctgttttctcttggtaacagaaatatctgtgataccaccaagatatcttgctatatgcataggtaaaatgtatcttccctattggcactcgttaggtctctggttcctcattttcattgctctaaagaatgtctcccgttgctttggggtgttcctcatctccacaaagtgagtttctgtgtctcatatagttcatattttatacagaagttctcagtatttgtggacagcatctgtggattcagccaaccatttatcaaaatattcagggatagaaatgcatctgtactgaatatgcacagacttttttcctagtcattatcccctagacaatacagtataacaactatttatacagcatttatgctgtattaggtattataagtaatctagagatgatttaaaatatatagaagatttgcgtatgcaaatactataccattttatatcagggacttgagcatccattcccccacaaacactgaagaacaactgtattaggtattatacaataccatataaatgtattaaaatccacctttcacatgaagcgagtaacagaatagtagaagcttaattgtactcataagtagggcaaaatgcttttagcttggatagaaaggatagtttgagaaggtaaggattaaggaagataagagagtttgattttgacataatgagtttgaggtatgcagtatatctaattatttggtagaaaagtaacctccaggcctggagattaggtaaaattgttttgttgattctgtattgtttatcaatataaaattgaaaaggtgagagaataagtgacttgccaaagtaaggaaaaagtagcagaaccaagcattttacgaaagatatttagtagttgtaaatacaaatatgaaattcagaacaatttttttttcacacttttttccctcatctccttttggtgtgcctattgaaatgaactgaagatcttgtttttttcattagagtcccaagagtggcccaaaagagagaatttatctagaggaaaacccagagaaaagtgaaacaattcaggacactgtgagtatgaaatccatgcaatgatagtgctgtctttggctttccttatacttaaagtatggtatagacacatctgatgtttacatattttattttttattttttggaaaaaaaattaaaatttattaaagaaacttaataaagatttgaataagtcaagagatattccatggtttgtaagtattcttaggttccttcatatttgtcgtggtggtaacataaaatgtactagtttaaccatttttaagtgtatagtggcattaagtatattcacattgttgtgcgaccatcactgccaaccatcttctccaactgcaatttggtacccggtaaacactaagtctacatttcccccttccccctagcccctggcagccaccattctactttctgtctctatgaatttgactactttagatactcatgtaaaaagaatgatacaatgtttatccgttcatgactggcttctctcacttagcatatgtcttcagctttcatccgtgttgtagcatgtgtcagaatttccgtcctttttgagaccaaataatattccatgacatgtatatacaccacattttgtttatctgtccgtttgtcagtgggtacttagattgcttccactttttgctattgtgaatatgctgccttgccttcagtttttgtgggtgttcatcaagaagaagaattgtttgatcttacgtattcttaattgcatgcttttaagcactctgattttatcttctaattacatttatttacagttttgtagtaaaagatacaacagcattttgtcatctttttattgttagcaacataaggactattgaaaaatcagagacatcaaatcagttataaaatcaaaattgtctgactactgctcgaaactaatttatgttgtttcacctaatttcttttttttaattttttaatttttcctttttttaaagagggagtttcgccatgttggccaggctgttctcaaactcctgacctcaggtgatccacccgcctcagcctcccaaagtgctgggattataggcatgagccacagtgcccggccagtttcacctgatttttttttggaatattaaagccttgaggttaaagaaaataataagagttgttaaaaggcagaattgtgtttaggagactcaatatgtagtgttgcaacactaggaggaaaaactacaggtacatattattcactcagtttaaaacttgcggatctgtttatacaacttcagctatagccactataactgctgtgcaaatgactctcaaatcataggcctacccttctttgctgaactccatccagatcttgcaatgttaaactgctgttagatttaagccaaactcatttttttcctatttcttccaaaatttttattccccaatcctatatggtctttaattttagtacttatggtcttcagacatcctgtatgtatgtatgtatttatgtatgcatgtatttatgtatgtatatatgtatgaatgagacagagtcttactctgttgcccaagctgcagtacagaggttaactgtaacctcaaactcctgggctcaaactgtgtacccactttggcctcccaagtagctaagactatagacacacgccaccacgcctggctaatttattttggtttttttagagatgggtcttgttgtttttcccaggctggtttcaaactcctggcctcaagtgatcctccctccttgacctcccaaagtgctgcgattacaggcctgagctaccgtgcccagcacccatgtttattattttatatattaatgcctctgtactgccgtttttgtgctgaatctaactttgtgagttgacaaatggaggagctattgcatgggaaactatctgacaatctacaatttattcttagaattttgttatctttgtttctatagcagtgtttgtgagattacttgatgattttagagcattgtatcagtgatttttcaatcaagagtgattatgcctccgtggacatttgacaaatgtctggaaacgctgcagctggcatctggtgggtgcatagaggtcaggggtgctgctaagtgtcttagaatgcacgggctagaccctacagccaagaactctctggcgcaaaatgtcaacagtgccgcagttgagaaaccctgcattatacatttatgaaaattaattaaaaatgaaaacatagagttcgatgatagccttcaattatgtatcattaatggaaatcttgggttagtacttctcaggtatattagcctctctgctaactttgtcttaccatttctgctcttatttttcctttctcctattgtcttcattcactttttctttaattttttaattgtaaccatttatgtaagccaactttatttttttctgtaagaagttttaagtatgtatgaattaataaaagaatgtacagaagtgtacagaaagtgttaaagtcagataaccaagtgtatagtgagcaaaggatatttactgtttccaaggggagtggttttttccccccaaaaaaaactcgttgttgtggtctttttctctgccagagtggtacatggccttgaaaatttgtgaacccctactttgaaaataaagtacttcaaaggaaataaacaaaaagaaatctcaccatttaagtgaaccatgtctttttgatgggttggctttattctttttctaaatttgaccaccaggtaatttttctgtttcttttccctgaatgttgccaggacactcaatcacttgtcggaagtccctcaacccgtatagcacctcatattattggagcagaagatgatgattttggtactgaacatgaacaggtgatgacttttttctttctaaaaaatagattgttactttctgcaatatctgatttgttgcaaaaatgagcacgttctggagattaagataacatttgtaaggatttgaagctaaatcttagaaccaatagctccttgggttaattgcttattttagctttgaccaacagaaatgaccttgcttttaaagccagtgagagatcattaatatatgtttaagtacttcattttattggggttgagtgtgtttcttaaaatagtatttttaaaaaaaatttcaaatcccagttcattggtgctataaaggaatatgattagctagattcttgtccttgtatcctgtgatcttgctaaattcacttattatttcttggtgcttttaaaaataagtcttttggagttttctacatagataaatatgttgtctatagtttttatttccttattttcaagctgtttatcttttatttcttgttcttgcctttattgcactggctaggacttccactatgaggttgaatcagagtgacaagacatgcttgccttattcctgctattagggagaaaacactcagtctttcatcattaagtatgatgttagctataagtattttttagaggctctttataaggttaagggttattaggttaaggaatactcctggtttgctgagagtttttatcatcactggatgttgaattttgtggaatgagattattatgtggtttttctgattgtctattaatatggtaagttatgttgattgatattagaatattaaactagtctcgcattcctggaatgaacctcagttggtcatgatatgttatcccttttatatattgtcggtttcaatttgccatattttactgaggattttttacatctttgttgatgaaggatattggtgtgttgtttttctttttgtaatacctttgtctggtttgatagttgggggtaatgctggtctttagaatgatttgggaatatgaaaattgtgatgctagtttacattattattgttttctgtgttcagtatatttagggattatacaaatattctaggatttgtcttacttaaaatcatacaacttcatttcccaccatttctgcaattagcccagaagaaaaggataaacagctattttatgattgggcaaaaagccttccactgcatttctagaaatgttagactgttttttacatactgatttgtatacatccgagctacttgataatcgtctcctaaatttccgttctcccacagtggtctttcttctaacctatccccaagaggtggttaatgttcacagaaagagattccatagcttctgttgctaataaattttagtgaagttttttaaatcttgaattttttatagggagatcaaagtgaaatttggatagctatgttcaattgagcctactttgcatttagtatttgtatgttggagttactgatgcataatcatttcttcctctagatcaatggacagtgcagctgtttccagagcattgaattactaaaatctcgcccggctcatttggctgttttcttacaccatgtagtttcacaatttgaccctgcgactttggtaatatattttacaatctagcagattcagagttcttctgttgattcatgtgccatagaacttttcctagctatacaacgagtgggcagacttctttcagttttccgtataaagacagatacaaaagataattaaaacattatttttaaagacttggttatatagtaataactacattgtttatggtgacctacctgttccagacattcctactcaatggtgacctagcaaattacatttttcatggttcctcattttgtctttttcattcctttctccactacagctctgttatctctattcagacctgtataaacataccaattccaaagaaactcgtcgcatcttccttgagtttcatcagttctttctagatcgatcagcagtaagttgccaagttaatgttgtaatctttgccttagtacatggaattattgtcctcctgcttcctatcttccctcccatgtttttggattttactgtgctttctcacacctgtattatatttcaattattgattactctagacttttttttttttatcatttctaaagtagtttaggcatatgaattctcacagtaggttttaggggattatatatatatatatacacacacacacacacacacacacacacatatatatacacacacacacacacacatatttgtgttttttgcatgtgcataattagagtgaggaaatgaaaaagggaatacatatatattaagacccaaggaataatacttgaataactgaactctgggtggcctctttgaagtttggaggcataattttaactaaaaagtggcagaaaagatttcacttacactgaaataaatgatgataacgttatattttgtcattaaaagtgttaataaggtttttaaagtagtaagttttattattagtcttgttatgggtaaatagcacctagcccttaatgcatactggataatcatgccgcaggtccctagtcctttcacatttgcagttcccttagacgactgcctcatgctttttccctcctaaaacctccatcacttcctttcctagtcctttctcagctgataaccttgaccttattgtttctctgagaaatttaaagtatatagaagagaacttctaccagatgtatcatctgccctcattataccataccatgtactctactctttctcctgatgctatggagtgactgtcttttttttttttttttttgagacagagtcttgctctgttgcccaggctggagcacagtggcacgattgcacctcactggaagctctgcctcctgggctcaagtgatcctcctgcctcagcctcccaagtagctgggactacaggtgtacaccatcatgcctggctaatttttgtattttgtagagccggggtttcgccatgttgcccaggctggtcttgaactcctaggctcaagcaatctgcctgcttcatcctctcaaagtgctgcgattacaggcatgagccaccgcacctggccttgattgtccatcttttatccaaggccagctctgctccagtttacagtgtatttccttatacctactcaaagatcttactctaacaattatcctcccttctcctgcatcatcggttttatattttctacagataatcattcacattagtctgcaaatgttgttattttccctttctaaaaacaaacacacattttggctctacttctccctccaactcctgccccgttttctttgtatgcctttacaaaattgtctgtacactttcacattcaattacctactcagtgactttcctaaccaacctacttaaaatctcaaccctttcactttgtcactttttctattatttttgtccatagaacttttatttagttagttagtttgtttacacagtcagtcttctgtgcctgcagcttccacgaattcaactaaccatggttgaaaatattcaaggaaaaaaacaaaagccaataccacaataaaaaatgaaacaattttttaaaaatatagtataacaactatttgcatagcgtttacattgtattaggtattataattaatctagagatttaaagtatacagcaagatgtgcataggttatatgcaaatacagtgccattttgtacaacggacttgagagttcgctgattttagtatccatgggggttcctagaaccggtaccccatgtggatatcaagggatgactatattcctactctcctaccctgaatataagttttattaggccagatatttttattctgtttgttcactgctgtgtccctaacactgaacagttcctgggacatagcggggtcacttaagtatgtgttaagtgaattagtgttctgatcctactcccattgtttaaaatattgtgttatttttattaaaataatttactttcctaaaaaaatgacaatatattgaagcatgtttgaattttgcatttcttaagagggcaccaagctaagtcaaaactttacattttgctacacatgatctatatatcaatattaaagtataagaagaatccttacactttgattaatttgctaattatacttttatgctacagctcacatttatttcatatatacaccatcatacagaaatgagcttttattacttttttgcacttgagctagaaatgcttttaagaaagttgatttgagctactgcctgtcaaagagaaagttttaaaatccattttacttttcttcaaatgaatataaagagatcttacaatttttagcggtgacttattttcaaatttaaaacttcagatcttataggatgtgtttaaattctgaaattgtatgacttaaataggtatacaatacaaaataagcaggaagaggttaagatattttctcttaatgcaaaataataaagtattcccctccattagtttgggggtgggggaaaacaacagactggtaattattatgcaaatattatggggaaaatcctagctaggaataagtaaattctaagatagtcaccttatttggttcagtagcaagaactgtagatggttgctggagatttaaaactccaaaaactcaacattgacattcaatattttctcactgggagtgtgacattgtgagggctcttaaactttacataggaaaacgattaggaatattattggtcttcagaatgagcatctcaaatataggaaagaaaaatcatggctatatgtgagtacatttttcatatgataatatacacataatttaggttttacctatattgatctaaatgacatataactgattatattgaccaatgattctaggaagccaaagccaaagccagtatattcattaagtgtgtcacagaagcattcagtcatctagctaaacgactgtagacttttcctttatagcatgatcctcgggaaaagggctcattttcaagtttaaacgatagaatgttctggagttgtgaaatgtgaatgaataaatgagcttgtacttgattgtgcttgtagagtgggtatccaagttgtatccccttactttacagaagtacttatgtacatcttcaaatatctttagcgttgttacaccttttgtttgcatttcattttagcacctgaaagtttctgttcctgatgaaatgtctgcagatctaggtaagcttggagcactaacatcctggagaattacatcttaatagatatgtagctcagctcatctgttcaggttttatctgtcacatggtgactagtcgatcacctgaatcacaacagaaagacagtctataatacatttaaagagtaaatgaggccgggcgtagtggctcacgcctgtaatcccagcactttggaaggccaaggtgggtggattacctgaggtcaagagttcgagaccagccttgccaacatggtggaaccctgtttctactgaaaatacaaaaatgagctggcatgatggtgcatgcctgtaatcccagctacttaggaggctgaggcaggagaattgcttgaacacaggaggcggaggttgcagtgagctgagattatgccattaacactccagcctgggtgataagagcaaaactctgtctcaaaaaaaataataatatggctgggcgcagtggctcacgcctgtagtactcccagcactttgggaggccgaggcgggtggatcacgaggtcaggagatcgaccatcctggctaacacagtgaaaccttgtctctactaaaaaacaaaaaagtagctgggcgtggtggcgggcgcctgttgtctcagctactcaggaggctgaggcaggagaatggcatgaaccccggaggtggagcttgcagtgagctgagatcgcgccactgcactccagcctgggcaacagagcaagactccatctcaaataataataataataataataataataataataataatagagtaaatgaaatcagaattctgggatgaaatatacgaactgccctgaagaacttccctctggcatattctaagttaatttgtacgaagtagcattgctatgttgccaattgtatgttgcccagaacatacctttagataacataattcctttcatttatgaagaaaagagaagacctgagctcattcctgaggatctgcatcgccactatatccaaactatgcaagaaagagtccatccagaagttcaaaggcacttagaagattttcggtaagcttagtggtagatagaatttcatatgattattctaaattaatttttttagttaagaaaaagttgctcattaaatacttagcttagcactagataaaccatatggtcttattgttattaaaacataatgaacatctggagccaaagggttagagtggaactgagagtccagactctccattccaggcacttgcaggatctgagctcagtgctgtgtctatgctaagtgtgttcctttaagatattgtatgtgttcttggagtcattgcttctagaattttttcctctggtatcctagatgacatggacccataagtggaaaagtgacatttttcctgttcctagaaaccatagctgtgaagactgtgatgaagcgtccccagaatgaggtagtttttctttaggctacctcaggaaacttctctattcccttcaggcagaaacgtagtatgggactgaccttggctgaaagcgagctgactaaacttgatgcagagcgagacaaggaccgattgactttggagaaggagcggacatgtgcagaacagattgttgccaaaattgaagaagtattgtaagtaatagaagtatatgtggaaatgccctctctgctgagatactagttatgcttgaagtgtcctttgggtaggtttagaaaaactgtcagattgtgtatgtggagccgtttattttgtcatagtacttgagaaactggattttttttttcttttttctgatacttttagataaatttcttgtgttcctttttctgggtggtggtaaatgggtaactctaaaacttctaatcagtgatcaaaaacaggttgattactttcattattttcaatttataggccttggaaatatttcttgccatgaagcatatacagttggtgacatgagggtgaaacagataaggttctttaggggatcagggttcttttggtattttattctagggtgtggcccaaagcatttggctctgttctgttatttcaggtatctgagttaataacaatttttaaggccaggcatggtggcgcactcctgtaatcccagcactttgggaggccgagcgggcggattacgtaaggccaagagttcgagaccaagctggccaacatggtgaaaccccatctctactaaaaaccccaaaattagccaggcatggtggcactcctgtaatcccagctactcagaaggctgaggcacgagaatcacttgcgcccaggaggcggaggttgcagtgagccaggatcatgccattgcactccagcctgggtggcagagtgagactctgtctcaaaaaaattaattaaacttccatatttcatttttaaatttttttttcttttttttaaggatgactgctcaggctgtagaggaagataagaggtaacataactgttttttttcccctagaattttaagaaaaaaagaactatgtttttttcctttcagtcctaaattacaatttatttcttttaacttacaaatacagtttgtggtctctctctggtggcttgtatgttatttgactaatattctactgttgtcctgagtagaattctcttctctgtgcaatgactagttagttctttagtgtttgtttgatttatttcaataattccaaccttggggttttggaaatcatttgatgtctttattctaccaaccctcccttctcagaagtcttaatttacttcgtcctttctcctccagctccaccatgcagtatgttattctcatgtatatgaagcatttgggagtaaaagtgaaagagcctcgaaatttggagcacaaacggggtcggattggatttcttcccaaaatcaaggtaagaatgaaataatgtaatagcatgttcaggccttagggcttctttacatttggttgcagtgtcttccatcatcttagtatttacttaatcagcaaattaatgctagtcatacaaacatttataagatactgtctctgttctcaagaaactcaaaatacagtgagaaatccagacatataaactattattagacaatgtgaaaagtgaaattagcagtttacaaagagtgctatttctgattctgttcatgccttatactttccttttactttgcctaaactaaataccccctgtgttgctacataatcgtcatgaacatctttagtggcagtagagtattctgtcagtttgtaattatttgtgtttttgtttagtgtttactagattgtaaagctgtatgagtacaaggaccttctttattattgtattttcaactgttagcaaaatgcttagtaaatatttgttgaatggatgaatgaattgtttagaataagttcctggtaaatgtgctataaaactaccctttgattttccaaagctgtcagtgataaagagtttgaagaaaacatcttgagtttgaggtgtacacggtactgtgtgcgaacttttaattagtgctctgtgtgcatacacacgtgtacgggttttcatttacacttaacaatttctttgaactaaccattagcattacactatgaaaatcgcaaaagaaatttactctgttacgtatctcttattttttgtacttcaactctagcaaagtatgaagaaagataaagaaggggaagaaaaagggaagcgaagaggattccccagcatcctgggacccccacggagaccaagccgtcatgacaacagtgcaagtatgttgaagtttgaagtgctgcattttcagtactccaggccctcttcacatcagaggcttcttcagctagaatgaatttctggagaaaggagttgttaggatgattttactgaattcccaatatgccttgtttccattcagcgttatttctgaactaagtaccccctatgttgctacataattgtcataaacatctttcgtgggctgggcgtggtgattcacgcctgtaatcccagcagtttgggaggctgaggcaggcggatcacaagttcaggagatcgagaccatcctggctaacacaatgaagcctgtctctactaaaaataccaacaattagccaggcgtggtggcatgcgcctgtagtcccagctactcgggaggctgaggtaggagaattgcttgaacctgggaggcagaggttgtagtgagccgagattgcaccactgcactcaagcctgggtgacactggagcgagactctgcctcaataaaacaaaaagaaaagaaaaaaaaaaaacgaaaacacacatctttagtggcagtattctgtcaaatgtccgtaacatagtttacttacctcttctgattctgtttccattcaacttgtgtttgttaaattaaaaaaaaaaagtgtgtatagatctctccaccacactgaacgtctctttatacatatttacttagtctccatatttctaaaatttctccacctctccattgtactttattttctgatttccctttcaccccaggcccaataaagagagataagctcacttgagatggctgcaggagaaatagggatggtggtaccatggggaggggtcatgtgatggttcttatctcaggcagtagcacatttgaaaatactgaagccaggtgcggtgactcttgattgtaattccagcactttgcaaggccaaggcgggaggatcacttgagcctgggagttcgagaccagcctgagctacatagtgagaccctgcctctacaacaagaacagccaaaataagctgtgtatcatggtgcatgtgtgtagtctgagctacctgggaggctgaggtagtattgctttagtctggggagtccaggctgctgtgagccatcatctcgccactaaactccagcctgggtgacagagtgaaacactgtctcaaaaaaaaaaaaaaaaaaaaaaagatattggcatggtagagtggtgggagtaggattgtgatagtgagtgtcccccacaatgacgagttctccctcaaatgccatgagtgcctcttgttgagaaacattgagaaggtgtgaaatttttagaggaagttaaagagatggaggatttcacagatgctaaccgtgagttccaaggtatacaaaagaagaatttgaggaattaagagattagggtataaaaagttgtgtgagggtgtaggatgctttggatattgaacacctgagtgggagtctttggcttcttgtggtgactttgtgaacaaggataattagcaggatggggattggtctggatggtctttgaggtacattatgatgatgaaggtgtgagtgttgggggagaactggggtgggagcttactaagaactcacaaaaataaagacttcatcttcattcttacaaatgaacacagctccatgtctctcagcattcctcctccctctgtccaccattcctctccttcttttctcatgacccttcttctttccctacatcctcctcttcctcgctttcgtcgtcctgcctcacccctcctccatctcctcatctttctgctctaccttcctctccctttctctcttttcttcttccttccttcatctgtctgtctgtatgtttctctgcataacaatccactatatatattttttagggtctaccatgtttcacacattttaccagattcttttacattgtccttttttgcttttagctaatttgcaatgcagattattttatttattttatttatttatttttgagacggagtcttgctctgtcacccaggctggagtgcagtggcgcaatttcggctcactgcaacctccgcctcccgggttggagcgattctcctgcctcagccttccgagtagctgggattacaggcatgtgccaccacgcccagctaatttttgtatttttaatagagacggggtttcaccatattagccaggatggtctcgatctcctgacctcatgattcgcccaccttggcctcccaaagtgttgggattataggcttgagccaccgcacccagccgcaatacagattattaaccatcattttctgatcagttggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggtgagctattactgtagttcagcttaactaagcatcaagattttaaaacaaacacactaactgaaaaatagagtggcaagttaatcaagactaaatcccagtttaatttaattttgacattttaatatgctacaaccaataagaaatctatgccgaatgataacttaagttctcatttgtccaaaaaaatatttattaagctctctgtcaggcattagctttgtcccggatgttaacatgcaataattatacacagatgcttgcctcatgcagctttctctcttgagagcgatagtcacaaatgtaaaaaatgcaaattgtgccaagtccaatcaagggaaggtaaagggagtattgagggaactggtcagtagttagaggcagatgtgggtatctaaagaagactttttaaaaatctgagattaactagaggttttatttttcaatgttaataggaagccagctgaaagaaagggtagaatatgtgggagacagtatataagtagtagaacagagttgtgaggagagaggagatgagatgtagagtgtatgtaaagggtaagactatttactgagagtgagagttcagtgagaagagcaagggaatttgaagagtaaagaaagatatgaagcaatcgtaggtaattgggcaaggagcttattaccatgtcttcatccttgtttgggaggcggttcaatttctggtggtgacatgatcaagaatgaggctctgggagtggtccctgaggtgccatagaggaggctactagggatgaagacggcaaggaaccaagaagccaggagtttgaatagcttaatattcatggctagtgacgtcaccaagtgtgatttttatcatggagaggaaaactgtgagccaccagccaaaggtttagcattgctagatgattgatatgaggaggaagagaatgtgataatatccagagcatgagagcctcagtggagcaagagattatacaggaagacaaggtcgggtgcagtggctcatgcctgtaatcccagcactttgggaggctgaggcgggtggatcacctgagatcaggagttggagagcagcctggccaacatggtgaaacccggtctctactaaaaatacaaaaattggccaggcatggtgacatgcacccgtaatcccaggtcctcgggaggctgaggcaggagaattgcttgaatccaggaggtgggtggaggttgcagtgagccaagatcgtgccaatgcactccagcctgggcaacagagtgagactccatctcaaaaaacaaaaacaaaaacaaaaaaaaacgacaagataatggtccaaaaatcatattgaggaacaagaaggccattcatctcatctccaccctgacatacaccatataagacagaaatattagtttctgtctcagagggctgtagcagaagaggtaagctgctgggaataggcaggtttctacataaggccaagaagtacaagtgacatttggagaaaattctggggattttgtcaaatatggaactctgaagatgttagattgggtatatgcactgatatttcatggctcctgtgacttattaaaataaaaacatggtaggtggcggatgaacagaaaccataaagagaaagaaagtagaggaagggaatgtgttatcaggaaataagagattttaacaaatacttgggagattgaaagcagacaagagtgtaaagaagccaggcatggtggcttactcctgtaatcccagaactttgggaggctgaggcaggaggattgcttgagcctagaaattcaggaccagccagggcaacatgaaaagactgtctctacaaaaaatgaagaagtcagccagtcatatggcatgtgcctgtagtcctagctaatcaagaggctgaggtgggatgatcacttgatcctaggaagacaaggctgcagtgagccatgttcttgccaccgttaatgcagcctggatgacagaatgagaccctatctcaagaaaaacaacaacagagaaccacaagataaaaccataaaggaagccagagcccacaatttgtttaaacagtccaagatagaacccagtctgctcattggaaccctggagagactttgggctcagagttagcatatgttatgcagtgcaggaataagaaaaagagcaaaaatgatgaactaattgcaggtctataatcaaaatagttatatcagcagcttctaatccctgaattacagagtatgagcagtctctgtcacttgtagactagaagaaaaaaacagtgctcttttttaaaataattcagtgaattgtgtagggagagttaagtccctccgcagtattgatcgcttggagttctgacatttgggagtccaaagcctgacactaggcatgccggcaacccactgtgctcagagagctctcaactgaaacagacctattactatatagcagcaaaagaaagccaagtcagctactcactttcatcattaaacacgaacatcattactcacccttgtcagagtcaagacgtaagataatatataatgccaaacatatcagacaatgacataaagagagaatacagttaaacagaagaattttccctacaagagaaagataatctgataatagacaagaacttaagaaaatacttctaaattaggtagtatacttggggacattaaagaagttattatctctataaagcaagaatagggagcattcagagacaaaatatttttaatacaactattaaacacagtgacatctgttgtattatcaatttctgtgtgataaattaccccaaaacataatggcttaacacaaaaaaaatttatctcgactttttggtggatgaaggactccagagcagcttagctgcgtgggtctcggttggagtctgtcataaagttgcagtcaagatattagccagtcatcagaaagcttaactggggctggggaacccatttctgtgcccactcaggtggctgttggcaggaggccttagctcctcactcatggccttggctccttgccacatggacttttccatagagatacttgagtgttccatgaaatggtagctggcttttcccgagtatcccaaaaaagagagcgaaaaggaagccccaatgtcttttctgacttagtctctataggtgcactctgtcacttctgcaagttagaaacaagtcactaaatctagcccatactcagggagggaggaattaggctccacccctgaggggagaaatatcaaaaaatgtgtgggtatattttcagaccaccacagcgatcagagtttaaaggaaaaaaaagaagtccctaaaattaaagtcaaggaaatattttagagtgtacatcagaaatatgaaaggatagaaatttgagagaaaagaattatatagggaaccactacagagagccaacatctgtctctttcacaaaaagtcagctgaggacatggagaagagatggttaaacaacaggagaaagtttcccagagttgaaaaagaatacccatcttcaggtggaaagggctcactgagaaccatctatagtgaatgctttttaaaaaatccattcctaacatgtcctttgaaactgtagtgcaccagggataagctttcagaggaaaaaaaatggggattacactgcatcacattcctcatcataacactggatgctgaaatacaaaagagccatgccttcaactttctgaaggaaaatggttttgaacttagaatcctgtatccatccaagctattcatcaaatatgaagaatgaataaagacattttcagatacacaaggtccacagtttaactggaatgtacctttccctttgaaatcatttgaggatacacattctagcaacatgagaggaaaaattaagaaagaaaatgtcctgggatccaggaaacactggaaacacccaggaaagtggcaaagggcaattctaaaatgatggttgtgtaacaggccaggagagccactgctccagattggaacacaagaacatcacagataagaaaatggggattttaggcagtggatagtatgaagcagcagaggaaatagtttgagacttgatagaattatataactttgacagcaataaaagaaaagcatttagaaatgttaagaaaaacagaattgttcaggaaaataagtcatgatttaaacatgaagcaaaataaaaagtggcatgatctttagcaattgatggtgtgtaagaaagactttaataaatgttctatttgaagtggcccatggattgcatcattggaccggtaggaaaaaatatataatcctaactagtatatttcttaatctggcaggaatgatgtatatatgtatgtagtagacgacagtatatatatgtcataagcattctttcttggttttcagacttttagaataaccctaccaggcaagcatggagtagttcattatggctgcaggttagaatataaatgtaaaaaattcttttaatgatgcaagtaaaaatgtagttgaaagaaatggaaggtagaaggaaggaaatacaattagagggaggatgtggacactgaatacctaatctgacacagaagagagttgagatactaactttttgatagaacaaaaacatagacatgtcatttaaatttaggtagtaactaataacccagctagtaataatgataaaactattaaacattgggaagaaatggtagaaaagtgaaagtggaaagtgtaagtcaacaaaatcctcagaggggaaagaaatagatattaactaaagataataaatcatgaaaaagaggttatttgtagttggaccactgtaataactcacatttgaaaacatgaaaaaggattgatactgggagtagaaaaggataagatgggaaaatgttgttcctcatcatatactcttctgcactgtgtgagtccttgctatttcttacgttaatttttaagaaacagttttaaaaattatttttctgaccaggcatggtggctcacacctataatcctagcactttgggtggccaaggcgaaaggattgcttgagcccaggaattcaagactagcctgggcaaagtagcaaaaccctatctctacaaaaaaattaaaaatgagccaggtgtgtgtggtggcacgcaactgtaggccccgctacttggaaggctgagatggaaggatcatatgaggctgagatgggaggatcatgtgagcctgagatgccataattttgtatattaaatttttagttctagtgaacctgcagttgtttaaataagaatgtagctatggattaggctgaagctgttctgggaactaattttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatggtgagtgtaatcaatttgttgttgttgtttacaaatactgagttttgtcagagtgaattaagtctctcagccttggagtttgcttcaaagtttctcctagccttttgttttaaacaaagaggaaattaaactggacagataatccttgaactcaagaaaatgcaaatgtttctctgattcttattgataatttaaaaggaaaatgtgttaagccttaaagatatttaagattcatagcattatagatcttaaagttgaaaagtcattgcaacaactaagttatttttatgcatagattttaaatgaggaaggtaaagcccagggagattgaattcgttaagatcatacagctaataacgtgtaaggaaaaaaattcagttcctggtctttctgtatcgaagtgcagtgttctttatttaccctagcatgtatgtgataaatgtgtggcatgggtgctgtaccctttactatccttagcatgtgatatgaataaatatcttgtctctgacaatactgagacataatgaaattataagcctgaccccagaagtgagtgtttataggcaaattagataaccaaaagtactattatttcttaagagggctcaagttaaaggctatatgatgttggggcttacagttttcttaatgatgtagttgtgataggtgggtattattgtaaacagctggatgtgtttgggaatacactaaaaaaaatagttttgaatgatattttttatttgtcagtattcaactctcagagccagtatgtaggaaaatttcttggaatcagaatgacttcagagatatttcatcctttctaaatgataaataatttattatataattcatttgctacttcactccagctaaagactatgattgatcccatggaattgttctaagtaaggcaacatttcatatctctttcctgttcagaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatagtaagagaaattagctctgatctttgcccctaacatttccaatagagaaaagattgtgagtttaaaattttgtaaatgtacccatgttagtattcctgagattatgtgtgagaatgtaagataaataaaggaatgattggaactttgactagatccttttcctcacaatcaatctttcatgtacaatgtgtcaacatagggcttccagtctaaagtcattgcctaaggtgaaaaacatgaatagtcaaattcaccgttgaaaattttctatcaattatagtatatatatctctttaaatatatatatccaatataataatatacgtataaatgtgttttgtaaatagtagtgtatggtatataatcacatggttcggtaatttttaggaattgtttttatttttttgagatggagtctcgctctgttgcccaagctggagtgcagtggtgcagtcttggctcactgcaacctctgccccctgggttcaagggatcctcccacctcagccacctgagtaactgggattacaggcgtgcgccaccacacccagctaatttttgtatttttcgtagagatgggtttcaccatgttggccaggctggtctcaaattcctgacctcaagtgatccacccgcctgccttggcctccaaagtgctgggattataggcatgagccactgccccggcctcaggaattattttattgttttgttgcttggaacacttgaataagtatataaaaattctaccttgttgacattttattggttgaagtcatcttggacttttgtggacagtaatatgatgttcctctcatttataggtcactatttctctatgacccttaatttttttatctttctttttcatgtcatcactaactatcaacatctgctaactaaattgatgccttttattcctttgtggataatcttgggtttcacaggcatgcattgacaagttcaggcttgattacatccattgcctgcacacttaacacattttgagaggatcagtgaacagaattacttgtactgtttaaattcaagttctttttgagcatgattatagatggagtcttgaggttcaatgaatatttgatgcaaccaccgtgtatgtaatgtgctagtttccaaaaatgttttttgtttagcacctgtttttcagatagagcttataatatccagatgtgtaagcactatgtccagatttatatttaaggagataagaagcagctgtactactgtgaaaatcgtctttataaaaaaaaaaaattagctactctgtactaccagtaattctgtctacactgaatgtgttactaacgtttttctatctttttatctttagttggattgaatgaacaaatgaaggctgttcgaaagagaaatgagacctctgttatcgatcagattggggaagatttgctgacatgggtaaggaaattttctgtttctttttaatatttttatggacacttgatggttagattcaagttgagtaactaacctttccaaatatgcaaactcatccatgttgcaaagttaatgcaaagctgagaaaggtcaagcagtagattccatttcaagaaaccacctgttttgctcatctgtaagaagcagacccttatccattaaaagtcataccatgagattgcagtgattcagtcacaccttcaggctccactgtaatcctagtttttttgcagttacctcttccactgaagtcttgaacccctcgaagtcacctatgagggttggaatcaacttccaaactcctgttaatattgatattttgacctcctcctgtgaattatgaatgttcttaatggcatctagaataatgaatccttttcagaaggtattcagtttgctttgcccagaccaatcagaggaatcaccttatgaaatatatttcttaaataataagacttgaaagtgaaaattactccttggtccatgagctgcagaatggatattgtgttagcaggcctgcaaacaacattgatctccttgtacatctccatcagaagtctttaagtgaccatgtgcattgtcaatgggcagtaatattttaaaagtaactttttttttttctgagcagtaggtcttaacagacatgctgtcatctaggctttgttgtttcatttatagagcacagacagagtagatttagcattattcttaagggtcccaggaatttcagaatggtaaacaatcattggcttcaacttaaagtcattggcccctaacaagagagctggcctttcttttgacatgctgaagtcagacattgatttctcctctctagctatgaaagttctagatggcatcttcttccaatagaaggctatttcatctacattgaatatctgttgttcagtgtagccactgtaatcaattatctcaggtacgtcttctggataacttactatagcttctactgctatatcagcacttgctgcatcactttgtacttttatttttatggagatgacttcttttcttaaatctcatcagtttacccctgctaccttcaaactcttcgtctgcagcttccttacctctcagccttcatagaattgaagagaattaggggcttgctttgtattaggctttggcttaagggaatattgtggctgatttcatcttctttatacagactaataggctgtttcactttcctcttgttcatttgttcattggagtagcacttttatttccttcaagaattttttctttgtgttcacaagttggccatttggcgtaagagccaaatctcagcttttgacatgccttccttactaaacttaatcatttctagcttttaatttcaagtgagagatatgtgactcctcacttgaacccctaaagaccattgcagcattgttaattggcccaaattcaatattgttgtgtctcagaataaggaggcccaaggaaagggaagagagttgggggaatggtcagttggtggggcggtcagaacacacacaacatttttccattaggtttgccaccatatgtgggtgcagttcatggtgccccaaagcaataaatagtaacatcaaagatcactgatgacagatcaccgtaacagagtaaaatgaaacagcttaaactattatgagaactaccaaaatgtggcacagagacatgacatgagcacatggttttggaaaaacggcaccaacagacttgctcagggttgccatcaaccttcaatttgtaaaaaatggagtatctgcaaagtacaataaaaatgtgaggtatgcctgtacctgtaaaaagttgaggaaaagcagaatggtggtttgtaactgtcacatacaaagcgttaatttagaagaaggcattggccagaaatcataaaagcaaaaatcataaataggcctttagattttactcttgctgtttaaataaaatcattttggaaagtatttttccagtattgtttccttaagatcactttacatacacagacaatccttgacttactatggttccaacttcgacagtttttttactttacagtggtgggaaagtaatacacattcaatagaaaccatactttgaattttgaattttaatcttttccggagcttggcaatatgtggtatgttactcttgatgctgggcagcaacagtgagccacagctcctggtcagccatgtgatcacagggtaaacaaccactctacagtgtactgtactgctagatgattttgcccagctgtaggctaatgcaagtgttctgagcacatttaaggtcagctaggccaagctatggtatttggtaggttcagtgtattaaatgctttctcaacttaagatattttcaatttttgatggttttattaggatataagttcatcagaaatcaaggaacatctatacttaaactgcttgtaaaactactgtagaggccgggcgcagtggctcatgcctataatccctgcactttgggaggccgaggcaggcagatcacctgaggtcaggagtttaagaccagcttgaccaacatggagaaaccccatctctactaaaaatacaaaattagccaggcatggtagtgcatgtctgtaatcccagctactcgggaggctgaggcaggagaatcgcttgaacctgggaggtggaggttgcggtgagctgagatcgagccattgcactccagcctgggcaacaagagcgaaactcagtctcaaaaaaaaaaaaaaaaaaaaaccaaaaaaaactactgtagaactgcttgagtttgggggcattattttctttggtaaacccagctgctttttgtagttgtgtggtgctttgattgactaacatgctaaaaatgctgccagtctccttgttaaacatgttaaatgtcatattcatcatagagtaagaatacaaaattggagtgacctattaaaatattgctttgtatgtgtcctacttgaaaaaatactctgaatttatctacaaatgcgctacaggcgggctttttacaaaatgcctttatgtacaaacttttgggaatatggctttaaatggaagattatatggaaaacatcttcgtaaaccataaagcaattatctacaagtatagaggctgtattaaaaaacaatgtatttgacttctacgagcacctactagtaaatcactttttaggtgtttaaccatcagaaatcttaaaatcatggcacatgcaaacttaaatttacaaattaaaaaacattagtgagaagtataatttttagcaaaagaattcataagctcattgatctcccccaagccagctccagctgctgcacaggtgaaacagcagtgatttaattttgtttcaacacagaaaacttacggcctgcccatggtcatagtgggttttatactgagtaagaaggaatgctagtatgccaaggatttgcttcccagagtagtaagacagtagttgttgtaaaggcttcagggtgtaagaaaattaaattttaggccagatgtagtggctcatgcccataatcccagcactttgagaggccaaggcaggcggatcacttgatgtcaggagttcaagaccggcctggccaacatggtgaaaccccatctctactaaaaatacaaaaaaaattagccaggcgtggtggcacacgcctgtagtcccaactacttgggaggctgagacaggagaatcactggaacctgggaggcggaggttgcagtgagctgagattgcaccactatactccagcctgggccacagaatgagactgtctgaaaaaaaaaaaaatgaaaatttagtctcagtcttcaggcattttgtatcttatattctccaaatgtcagcttgtctgtgtaatttataagtaacgtaggctgaaaggtaataggttgtgataggctacaagcaagaaaacattgggactgggcacagtggctcacgcctgtaatcccagcactttggggacaccaaggtgggcagatcacctgaggtcaggagtttgagaacagcctggccaacatggtgaaaccccatctctactaaaaatacaaaaattagctgggtgtggtggtgtgtgcctgtagtcccagttacttgggaggcagaggtgagaatctcatgaacctcagaggcagaagttgcagtgagccaagatcatgccattgtactccagcctgggcgacagagcaacactgtctcaaaaaaaagaaaaaaaaaagaagaagaaaacattggaatatgatcagaaaaggtctggttgtgtcaagatcagacctttttaatggagaaccattgatattccacatagatatgcagttctgtgtattttgtcacttgaaatattgaaaggattctggttgtctgtcactttgtctggcttgtataagctcagtttcccattctcttttgtgttctttgcattcttggcacagttcagcggaccaggagaggagaaattgaaacatgctgctgctaccttttgcagtaaccaacctttcgccctggaaatgatcaaatctcgtcagaaaaaggattctcgatttcagacttttgtgcaagtgagttgagtgagtcatgtaagaaaaaaaataaggcaagtttttatcaattatcagataaactgggggaattctgactaagacttttacaaagattacatctgtgttaactttttttttttgagacagggtctcgctgtgttgcccaggctggagtgcaatggcacaatctcagctcactgcaacctctgcctcctgggttcaagcgattctcctgcctcagccttcctagtagttaggattacaggtacatgctaccacgccctgctaattttttctatttttagtagagacggggtttcaccatgttggccaggctgggctcgaacacctgacctcaagtgatctgcccacctcggcctcccgaagggattacaggtgtgagccactgcacctggcccacgttaacatttttaaaagcaatacattatctcttaaattcctggaaggtacaaaaatgactttggaatggtgaagaataataaaaaatatatgtcaggattaaaatacttaatatagaaatccacattgccacgaggcttttatcagtaaacaaccgtatgctctattaagagaatattgtcaaagcatgagaatgggtttatccagggaaaaacgtaacagcagccacactcattggggtatatgaattaagggttggtaaactatggccgacagaccatatctagtctgttacctgtttttataaagttttatgtaaatacaaacatggccgcttgacagatttctcacagttgttgtggtgtgtgggtatggtttagcaggttcctcccttgagagtttgaccaggctgagatcacagcgtcagcgggagctgcagttttcatctgatgctcgaggttctcttctaagctcactggttgttagcagagttcatttctttgtaaatgtataactgaggtcctaccttgctagctattggctaggaaccagtttcaactcctagagaacagagagatctctgccatatggccccattaggcagtttagaggtggatgtttgctttcttccaggccagtaggaatgtggctttctgacacagatttgttttaaaggctcctctaatgaaatcaggcccagccaggataatttcctttcttatgatctcaaaatcatgtggtggcaacctaatcataggtgtgatatcccattgtaatcacagattccaaaaatgttcatactcaagggcataggattacacagagtatttacacaagaggatgggaaccttggaggccatattagagttctttactacacagagccttgttcattcacttatgccaaaacagtagagctgaatagttgtgagagagactatatggcctgcaaagcctaaaatatttactatctggcattttactaaaaactttgcagaccactggtatagatgagctggcatactcgactggttatccattgtgcatacttggaatggcagataacaaattagctaaccaattttggtaggaatgtcaatcataggagaatggacctagattttctgaataggtgaagataaaactgtttcaacacaaggaagcgatacgtagagctgcttatggatgctttcagtccttccttaaacagataacaagccattcatttagtaatagaggctcccttcccccattatgtgattaaaggagaaagcagaagtatattgtggcaatgatatatcttggcattttttaaagatcttgatttaataaccagaactgtgatgcattaaaccctcacggtgaatacatggtacatgtataagttcaaataagaattacagattcacttatttcactttaattttaggatgctgaaagtaatccactgtgtcgtcgtcttcaactgaaggatattattcccactcaaatgcaaaggcttactaagtacccacttctgttggataatattgccaaatacacaggtacagcattttcactgaaataaaaagcttaagaacaacaacaacgaaacacccaatatcctgtaaataatatcttacagcgtcctgaatggagttggatttccaaatagtatgacaagattttctttttttttttttttttttccttttttgagacagggtctcactcagtcttgcaggctggagtgcagtggcacaatcatagtttcctgcaacctcaaactcctcggctcaggcattccttccacctcagcttcccgaacagctgggactacaggggtacaccaccacacttggctttttttttttttttttttagcaagggtctcactatgttgctcaggctggtctcaaactcctggcctcaagcagtcctcctgcctcccagagtgctgtgattataggcatgagtcaccatacccagccaagattttctaacaagatatgatctagtcttcttcgggctgtttgatataatgtactccattagtagctttagtacggggtatatcaaactatgaatcatagaccaagtcatgctcactgtctgtttttgtaaataaagttttattggagcacagccgtgctcgtctgtttatgtactgtccctgattgcttttacattataacagcagagtcgagtagttttatcggtgcccatttggcctacaaagtgtaaaattatctggttcaaccatccttgttctagcctgcatcatttttgctttgaagaaggttcatccttggctgaagagatgtttcatggatatctatcaatgacttttattaagccaaatcaatgcggtgtaattccaactctcccgttttgaaacatgaaatgaatctgtttctcagctgagctttaggttcttatacttagctctcattaataatttaatgcaactgaaatcttgtttcttgtgcctgagaatttgaatgcataagcaggaaattttaaattatggtacctggtaacaaaagtggtttacactcatacatattaatttttacactttaatatatctgctcagtgtagttagactgtggtttggaggattataattttgaatgttctgattttggtcttctttgtattatagacatgacatagcctcaatacgttttgtcttgttttgttttgttttgttttgtttttttgagacggagtctcgctctgtcgcccaggctggagtgaagtggcacaatctctgctcactgcaacctccacctcccgggttcaagcaattcccctgcctcagcctcccgagtagctgggattacaggcgcacgccaccacacctggctaatttttttgtatttttagtagaaacaaggtttcaccatattggccagactggtcttgaactcctgacctcaggcagtccgcctgccttggcctcccaaagtgctaggattacaggcatgagccaccttgccttgccgcctcaatacgttttgatgaatttcatcttcttttaatgtaatctattttctttctttaaatataatctcaaattcaaagaaacttgttttggaattattttgaattgtgttattaaaaaattttgtttaacaagttcactggacataattatgtaggctatgcactgtgaaattctgaggggagaagggatttccatttatattatttacaaagtaaatgagacctgcccttctggagtgtatagtatagtggtcctggtacttcacgtaaagcatctcttcttggatttcgggttctgtactgtgatttctttttaaagattagaatttatgttttaaagtcctgttataagaagttttacctgtccaaagactgcttgaattgagactctgacagaggctttaagctggtacaaaaatcttcaaggtcttaatatgctcttaaaagtattgaaatgaaatgaaatctcatttacatatattttatggttttttgctcagttcttttacattttggatttctttcccatatttagaatggccaacagaaagggagaaggtgaagaaagctgcagatcactgtcgtcagatcttaaattttgtaaatcaggctgtcaaggaggcagaaaacaagcaggtaaaaaaggaaaacaagaaggtacaggatgacattgggagaacattaaattaatattacctggaatctgtgaaatagttgttaaaactatcattacctaatggacagggagaacatttgtttactgttcgcatagtaggcaggtcaagatcaatctgtgatagaatatcggagttgtatttgactttttgaaacacctcaagctgcttgtttgctctttcatttatctcttcattcagcagatatttatagaacatctactgtatgctgggcatagggtacagagtagttgagaaaatgagtgcaatatctgcccacactgagcttgtttgctaggaggatagaaaggcatttaacaggattatagtgcaaatattttgtatcagttgtgatagctactatcaaggataatttcaagatgctacgatatataactatggggcctagcttagtttggggatgttaggtggtgcctattagagaaaattttcttgaggaattgacacttgagccaagctctgaaggatgagtggaagtgaaccaaaatgatgtgaagggtgcaaccctagaggtagaggcaatatataccaaagtcctgacggaaaaagaaagcatggtctgttggaagaattgaaaatttacatgagtgtggatcatgcctaaaaagcaaagtcagagtggcataaaatgaggtaaagtagaccaaggccaactcataaaggccctagagatcaggttaaagattttgatttgtcttcttaagtgcagtaggaattcagcatagacaagtaagaatatagtgttcagattttcattatctgaactagtactctatggagaatgagttgaagaagggtggtggatgaaagagcccatttattaacctcttgcagcaatctaggatagatgatggcagcttagagaagttggagaagtatttagaaggtaaaattgacaggacttgatgactgatttgaagaaggatttgaaggaaaagtgatgtcaagaataaacccccaggtttctggattgcatatttggatggacaggatgagtggagaagccccacgtttgtggggaagatgatgaggtcactctgggatatcaggtagacatgcacagtaagcagttggctgtatgggcccacctctaagaggaccatgttgaagataaaaattcaagattgtgagcatacaggggctgattgaatccgtgaacacggatgtagtttcttaggagctgagtatgattacaactctcttggtgaggctgtagaaaaactagtactttcagctgtgctgttcagagtgtaaaatgataaaaccccagagggttatgtagcaatatttatctaaattaaaactctgtaggtacccttatatctaccttttgactccgcagttctgttcctagtgatttgctcaagagaaatgaaccatattagagttctttactacacagagcctgttcatttatgtattatctgtggctacttttgttccaaaacagtggagctgaacaactgggagagagattatatggcctgcaaagcctaactgacattttactaaaaaccttgcagacccctggtatagatgagctggcatactcaggctggttatccattgtgcctgccgggaatggcacataacaaattaactaactaactttagtaggaacaccaatcataagcaaatggacctagattttctgaataataaaatatatctttatctgaagataaagatatacccacaaacagacttagaccagaatgcttatagcaactttattcataatagcgaaaagctagaaacagcccaagaatttatcaacagaatggataaaccaactgtggtatagttataaaatagaatgccctgagtgataggaaaggaatgtaccactaaggcacacaacatggatgaatctcacaaacatgctgagtggaaaaaaaacagatgcaaaagagtacatacctatgattccatttatatgaacttctaagagagaccaaactattctatggtaggaaaaaccagaaaactggttcccattggggatgaggaggtagaaattaactgggaagaagtatgaggaaactttctggggtgatggtaaaattttctatcatgatagaagtttaggttacacaaatgtgtaagcacttgtcaaaattcatggaacatacacttgaaatgtgtgttctactgtatgcaaattttacttttttaaaaagaactgtatggatgtttaaatgtttagaggtaaagtgtacttatgtctgtaatttattttgaaatgcatccaaaaaataagatggactgatggatagagggatgaataaatagatatatgataaaacaaatagagcaaatgttaattgtagaatatagatggtaatatataggtgttcactatgctcactcagacttttccatgtatttggaaatgatattgtgggggaatgtacataccctttgatccaacagttctggaaatttatcctacagatatcctacatggatgtacaaagacatatatttaagtccactttattacagtattgtttgttacagaagagttgaagtaacttaaatgcccatcagtaaggcgtaatgaaataaattatagtttattcagagagttttacatcctgtagtcatttataaaaaaatgaaataactctctatatgtgctaatgtggaacagtccccaagatataagtcatacaccacacacacacacacgtgggggaatacgtatatgaatgtattctaccatttcaatgaggaatacatataggaataccaaaggaatgcatatatgaatatattatgctaccatatcttgttttaaaaaaggacatatacacacaacatgcacaaagacaagcatacttatatatacatatataaataaatacatatctgtttgcatagaatttttctcaaaggctacccaagaaatggatattagtgattgcttctttagggaaaattgaggggggtggggcaataggacaaggttagagggagactttttattttttgccttatatagccatctgaattttgtactgtgtgcatgatttacatattcagaaaataaatataagctaataagagaccaatgactttgaaaagaagattgagaaagaaaagccaaagaggcaggaggaaaactaggagagtatattatcaccaaagccacgggaagagagtgagttttcagtcctgtctagcattgcaaagagctcagtaaaatggagattttttttttttgagatggagtcttgctgtgtcgcccaggctggagtgcagtggcgtgatctcggctcactgcaagctccgcctcccaggtttgcaccattcccctgcctcagcctcccaagtagctgggaccacaggcgcccgccaccatgcccggctaatttttttttatttttagtagagacggggtttcactgtgttagccaggatggtcttgatctcctaacctcgtgatccacctgcctcagcctcccaaagtgctgagattacaggtgtgagccaccacgcctggccaaaatggagattttaaatgccaagtttgattcagaaatagagaggtcattaatgaccaaagcactaaccttggttccaccctgcctaattttcagcgcctagaagattatcagcgtcgccttgatacctccagcctgaagttgtcagagtacccaaatgttgaagagctcagggtgagagatggtctaatcataatttaaaaaataaaataaaatttgctaaagacctggcaggtaattaacatctcagtgggaatatacgtcacctgaaggagttcttgtatcgtagattatctgtatttatgattttttttgctgccttttaaatgcttgatctgtatgaaattagtttttcattagaggaatatcttgcataaaactgtaatattacatgacagcaattggcaggagactaagggacactaattattataaaatttaattttattgtgttctgtagtttgtttcagacagggtcttgctctgttgcccaggctggaatgcagtggtgcagtcttggctcactgaagccttggcctcctggactcaggcagtccacccacctcagcctccctagcagctaggactataggtatatgccaccatacccagctaattctgtgttttgtaaagacaaggtctcgctgtgttgtcaggttggtccagatttcctgggctcaagtgctcctttctcagcctcccacagtgcagggattacaggcatgagccactatgcccagcctgtgttctgtagtttaaataagggtaggactgtttggtaactttccagatcatttaataacacaagatagcatactattttctcatgaggctcttcagaagcataaaagttggaaccattacaggaacgatagtaaaatgtttactaattgccacttctagtatgtgggcttatgtgttaactttttcggattttaagtgtttttgtaccatttcactaggtggtggttttggcagatttatttggtggctgttaaaatagacttttatgtcatatattaatacttcgtcaacaagcacgtaaatgtgcttattccccttagcttccaaagaatgagagttttctagagctgctaatactaaaagatgattctcttactaataagttgttaatatttagaccaagtctgagtagtacctggacttttcatgagtactatttcttagaactttctttgaaattagagccttggaactcagaagccactttcttatagacaagcatatgtaccatgctcatccagttattcataggaaaattaaaggatacgttgagaatctagtgactgaatgtttgtaacttgatcttcataatctgttatcatctgtttagagtgaggtttgaagatagtactcctgaatgttcttctgcaagataccttttcctttttagaaaattgtatgcagattactttaatatggcttttgtgccattttcaagaactgacaaatagcaataatgatagttgaatgtaaatggtgtattttatattaagaatttctttaaaagagactgtattatatagataatcatgttactgagtgcttggaaattatttgtgcatgattttctttattttgccagaatttggatttaacaaaaaggaagatgattcatgaagggccattggtttggaaggtgaatagagataaaactattggtaggtctgatattgtcttttagttttggggagagtggcaaaagggaaggaataggaaagtttcctatgacaaagggaagaggagagaaccattctctcagcagtttgcagtgctacctcgtgttatttgtacatttgtagatctgcttgtgttatttcattatatgtaagatgtgttaaatattcatttaggaatgtagtggagaactgatttagtcctatttccatcattcttatagtctagtgagtctttgtatgctttgtaagctttctttagaccagtacatcttaaactgtctgtgatgaggaaccgtttttgttttttcagaaacaaggtctttctatgttgcccaggctggagcacagtggctagtcacagatgcagtcatggtgcactgctgcctcgaactcctgggcttaagggatcctcctgccttagcctccctagtagccgggactataggcgcacagcaccacacccagcttgttgttttttatttcctattggtcacagactgacacttcagtgaaataaaataaaaatgaattactgaaaatgaaattttaaaagataatatacaagtcaatttttaaaattttgtagctttaacagaaatagaattcctctgttgaatcattataaagttaatcaaacgcgtctccatttctgtacttaccatttttttctgcacttttatttctagatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacaggcaagtatgtccactgaaggatactaatttccagattcattgtgaagttgcataagatactcggtgctgtctcaataacacaagtggcatagagtcttgctatttttatattcttaagcaaattacatgaaatttactgcttagaaagagacctaagagtttataccccaaagttattagggtgtctcgattctgtgaacagttttctgcatttgaaaatttttatgctattactttggttctttatgttcaaatcattgatagatcccaatgaaaagcctttcatttagggtggtatgttttttgatttggtgagaaaaaaatcaaaaaccaaagagacggatgtagtgttgattaaaaatcaaatttgactggcaagttatattttaactctattaacaacggggtcccttttaaaacttgttagtttcatggtggcaaaataaatttgtgacctcttttctccactactcactgaatattattaactaacaacttagcaaaagtgcagttcaaaataaatgcaaaagagtaatagcatttaatctggtaatttggatttatttattttttttcttttgagacgagggtcccaccctgtcacccaggctggagtgcagtggtacaaccttggcacactgcaacctccacatcccaggctcaagcaattcttcaacctcagcctcctgagtagctgggactacaggcatgcaccaccatgacctggctaatttttttgttttatgtagaggcagggtttcgccatgctgcccaggctggtctcgaactcctgagctccaagcggtccacctgcctcggcctcctaaagtactgggattacaggtgtgagccaccgtgcccggccagtaatttggatttttgacatgcttttagcaaagtttctagtaaattattgtggaattagtgctaattcgtataatctttgttttattgaagtacaataaatatagtacaataaatacgttaatatggtaagttgcacaaattttaagtgtacatcttgatgaattttaaagtaaatatatgtaacctttatctagtttaaggggcagactatttcaagaccctaaaaacatccctcatggcctccccaggtcatagtattagagtaatcttgtattgttttttccagataacaaagctttattcgtcatttccatgtcagacaatggcgctcagatttatgaactggtggcacagacagtttctgaaaagactgtgtatgtatcagatatggctaccttgctatagctaatattttcattatcccaagcgtaatattccataaacttaactttgtttttataatgtatggaaaccaagcacttcctctgtactcttttagagacgttctactatgaacttgttcttttttaggttgatgccttttattttgattctattctgaaagtttatttcctaaagaaaaaattgtgcaaaatgtcaagtgaagtttttttaatgtgtccatagatttctcttaaggtatagttttggactctcgccttaatagtgtgttgccaaaataaagatattctctggcagagtgggttttgttgttgttgttgttgttgttgttgttgttgttgttggttgatttggtttttgtttagttttgctttctgagtatatttaaaggatatttcttttttcttttttgtattttggatttctttccaactttctgaagctggcaggacctaatctgtcggatggctgcatcagtgaaggagcaatccacaaagccaattccattaccacagtcaacacctggcgagtgagtgttcctttgcattgtagtaggacttattttatgttttgggttggaaaagactaggataattattatgttttgttgcgatgatgtttagatacctcaggaaggtaaaagtttttttttttttttttttctctacagaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagataggcgtatcacctgaggccaggagttagaggccaacctgaccaacatgacaaaaccctgtctctactaaaaaatacaaaaattagccgggcatggtggtaggtgcctgtaatcccagctacttgggaggctgaggcagggagaattgcttgaacccaggaggcggaggttacggtgagccgagatcgtgccattgcactccagcctgggcaacaagaccgaaacaccaaaaaaaaaaaagaaaaaaagaaaaaaaagaaaataaaataaaatgcaaagaaactttaatactgtttggtttatgcaggttccagcatcagagattcagtttaacaaactttgcctttgagccttctgtgtgtcagtataacactgttctaagtgatgtgtatttttcttaacagatgatctctgtagtttatggattgttttttttttttctgattcttccctgaatgcttcatgttaaaagttaaaagctttgtttagatatagtctaccttttctattccattggacagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaattgtaagttttattcataacttattacagatacttactaagtatgacactcatgtgccatccctaaagtatgtggatttatcaaactccacttattcttctagttctattgtggagattatagtattctctacagtggcccatgccacaggcacacacacacatgccactctgttagctccccacccccctgcctggttcagaatcactgttaaaatgggaggatagcatatctctcagttgtattgaggtgggaaaaaggctgagaacaatttctttggctggggagaaccacttgaaatttttaaaccagcgtatgactaaaggtatgaaaaaagattaatctggctgaaagcggtggaaggatttgaatggaaagaggtatggaatggtgtacttactaaataagctattataatagtctggcctgagactaaaagagtttggactagaatgttatcagaaggaataagaagaaactgagaagtcatcaaatgcttaaaataattgacttctttgaatgtgaggtcaaaggaaagggaatatttagagataatttcattaatctagtcagaaataagagtcagaaaaggactaccactgcttcccccacctccttccattgtactttcttttttctttcttttgatttggtagaattataggctcagttttaaagcatgtcaagattaagataatgaatgacaaaacactaaaaagtgagtaactagcaggaagttagagttttaggagtgaaactttagagagaggttaggaagagatagagatgtgagcatcagagccatgagacttcctggcatctctcaggaagtgattgtagagcagaaggacagaggatgagagacctaagtggaacctgttgcctaaagaaacatgacagacattaagctagtgatgagagcagagaattggttatttaaaacctacaatattttttataccttctcctgaattaacagtcttaataatttctgatggttggaataacattgtcccaataactctatcattgtctgggtgacctcatagcatacacttggcccattcaaaattaaattggttcttattttcagtaaatgtatgtatctcataaaattagaggaaataatatgcatatagtgtctggatctggaaaaagcagaacttttttttagctttttctgtctagcttaacacagcctttcaacattcttaagaagtacctttagggtattattctagttatatagaagaaaaaatagaggcatgatattggttattgaggagttctaaatagtagtatctccctattcagaatgcttagatcttttcaagtttagtttaacgttaaatcttctctaaaagatggtgctttatttcatcttcaaaacaaaatggaaaatgattgtatgaagtaagatgattgtatgaaattaataattaacattttaatatgtcattaaaagatactttttaaagatagatcattggtaagtcagctaatttaattcttgcagcctgaggttatagttgtgaatatgttttttttccccctccttcctaaatcgtttagtgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggcaagtatctttcacacttaaactttgattttgattttgatcattgttaactgtcctgtattttgaaatggatgttgtattggtatccaggtgtgtgtgtgtgtgtgtgttcacacatgtgcaatatttattccttcatttgataaatactgaatctactctgtaccagacctcatcataggtgctgggagatatagcagtgaataaaacacagaaaaatcccatcttctcatgaagctaggggaaagaaggatggtaaataagtaaacaaataaatagacttcaggaagtattaggaagaaacataagtcagactgaggggacggagagtaatgaaggcaaacagggtgatcagggattaggacctccgatgaggtagcatttgagcagagacctcaatgaaatgagggaataaagccgggtgggtacctgggagcttactattccagcagagagcagagtggggcagaggctttgtgtcaaagagcaagctttttgtggtgatcgaacactggatgagggagacaatggcaggagatggggcaagagaggcgtttggcaggggaagtggtagcaagatcatttaggcactgtagtttccagctttaaacttttgaaatgaaattttttggaaattaccatgaaagtttgcagagtttagctttcatctgaagtgaggaaattctgatgtacctgaaactaaactcaggaattaatggcttttccctctcttaataacttttcaagttgaagttgtcagcacactatgctatttctgttttctaatggcagcactggtcttatcaaactattctgtctctatccataggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaaggtacctcatacttccacatccataggacttggttgtaagaaacatttagcagaggggaagaatagggtgatgaaaatgctgatgtcaataaacttgttcaggttctagatttctttgactattatccatgaataggcctgggtaaaaagttgagattggcattgtttatctttttctttctttctttttttttttttttttgagacggagtctcgctctgtcaaccaggctagagtgcagtggcgtgatctcagctcactgcaagctctgccttccaggttcacaccattctcctgcctcagcctcccaagcagctgggactacaggcacccgcccccacgcccagctaattttttgtatttttaatagagacggggtttcaccatgttagccaggatggtctcgatctcctgacctcgtgatccgcctgcctcggcctcccaaagtactgggattacaggcgtgagccaccgcgcccagtcggcattgtttatcttttgactatcacaagagcagaaaaagttgcagctctgtgaactgtgtgtttgtatgggtgtctaagtttaagaacctgaaatgcttcgggtagttggctggcctctgtcagacatgaacaagaagatgagataggtagggtttatgtagttatgaatctaggctgagaaatgctatgactttctgtagcctattatctgtgactcattaggtgacattggcagcttcccaaatcctatgacagatagaaattggcttcagtggctcctgtaatctaaaaacatggtcatgcatgggatttttgtagattggtaattgaagatgtcactattgcaaaactgacttgtgtggcaatttccaagagaaagacctatcttaaagttttccatcagaggcagggcacggtggctcacgcctgtaattccagcactttgggaggcaaggcaggcggatcacgaggtcaggagatcgagaccatccttgctaacacggtgaaaccccgtctctactaaaaataaaaaaaatcagccaggtgtggtggtgggcgcctgtagtcccagctactcaggaggctgaggcaggagaatggcatgaacctgggaggcggagcttgcagggagctgagatcacgccactgcactccaacctgggtgacagagcgagactctgtctcaaaaaaaaaaaaaaaagtttgccatcagaaaacacagcttccagagcccaaacattttcctcatgacatcatttacaccagagacttgaggggtagatttaagtatccttagcctttgagttaaagactggtctcccttagtttctcttttaccttcatataattgatttttccctcttcatgttacttattttatgtagtatcattctgtagctgatgagatatcgacaagcccattgaggacaggtcggttcttatatacagtcatgtgttgcttagcaatggggatatattctgagaaattcatcattaggcatttttatctttgtgtgaacttcacagagtgtacttacacaaacctagatagaatatatctttatttacatagattttttcatatggaaagccaaatctctcaacactattactgaatattagtcatttcccctacctgatcagcaatgccattattaagtgccacacaccaggtttctacatgtgctccataataatcttttttttttttttttttttttgagacagtcttgctctgtcacccaggctggagtgcagtggcgctatttcggctcactgcaacctctgcctcccaggttcaagcgattctcctgccttggcctcccaaggagctgggactacaggcaccaccaccatgcccagataaatttttttttttttttaaatggagtctcggtctgtcacccaggctggagtgcaatggtgcaatctcggctcaccgcaacctccgcctcccgggttcaagcgattctcctgcctcagcttcctgagtagctgggattacaggtgcccgccaccacacccagctaatttttttctatcttttaatttatttatgtatttatattttttgagacagagtcttgctctgtcgcccaggctggagtgcagtggcatgatctctcctcactgcaagctccacctcccaggttcacgccattctcctgcctcagcctccccagtagctgggactacaggcgcctgccaccatgcccggctaattttttttatttttagtagagacggggtttcaccatgttagcctggatggtctcgatctcctgacctcgtgatccgcctgcctcggcctcccaaagtgttgggattacaggcgtgagccaccgcgcccagtcccagctaatttttataattttagtagagacaggatttcaccatgttggccaggctggtctggaactcctgacctcaggtgatccacctgcctcggcctcccaaagtgctgggattacaggcgtgagccaccatgccccacccataataatcttaagggaccatcatcatgtatgcaggccgccatgtctttatgtgctgcatgactatagctcatgcacatgatgacgggaccatgtccagggtgactcctgggggtgggagaattgcatctatggttaccacctctactttctttttacatgggaaaatactaagttattccttcagtggagaaattggtaaaaggaatgaaatttacttttttcttcccactaatgaaatttttaatgatgaagttaatatttttgaaatttgggggcttgtacctgtaatgtaaaaagggcttcttttctgttttctgaagtttttgttttgttttgtttcattacgtttgaataaaaaacctatgggttttatttcacagaaggtggaggaaagttacaccattctttgccaaaggctggctggatcagccctcacagacaagcactcaggtatgtaaaagttatgagttccagactctagactaatcatcctacactgaatgaaatgacttatcatactttgaagtgaaaaccttctgagattccatttctcttctgtctttaaagaactgcctgtttctaaacatcagatatcaagcggaagctcatgcctgctgactctactcttctctaagaggaactgcagttgtcagttcccataccatcccctcttctctctcttttcaccttttcaaagcagaaggcagagcagtgggaagcctggtaaatcacagattcggtgtgaggcttactggtactgctgtgactccctagtgtggaggatttggccttattggatgttggtgcacttgcctctgctgacagtgtggctggtgtctcccctgactgcagatggatttgtgttccctgcagcagtttatactcatctgcttacatactgattcagaaacaaagattgaaccacgcccacagatgtcatgggtattctttgcaatgttagtatattctttttcttaatatcatttccatgtatctttattcttctcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 3 - DNA, 153525 bp, Homo sapiens
  source 1..153525: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggttggtatgaattcctccttcgttcggcctcccggaatcgggcccgacctagcaggggagtcggtgattgcagattgcctttggccagcgaagttgacaggcagaggaaagagggttgtttcggagctgtgcagttagcctggggttgctgccgagttatccagttgattggcttttggaaatgtaatttttccggagagaaacttcccttccgattctcagagaagggggaggcaaaaccatgattgtggttttccgcctgtagtgtgcattaggattgtgtactcgtctggaaatcagaggagaaggtcattttaggtgaaggtcggtgcctgaagtcggctcggtattggtgtattatttatcagctttagccgtgtcctgcagtagattctcaagacaattacattttaggaatttctacctgtgaacttaatgttgagcctactgcatggtgatctgggaacttgatctctttcagatgttgacctgcacggtgtttaattattatctaataactttccagaatgttgacattaccagtaaatcacaggttcttgctggaagcaatgtccaggagctgaagaaatgagggtaaatcatggggtttgcttttaattcttgtatttaaatatttcgtcttccagaaacacttggcgtttaagagatataagccgtaagcatagtgtaagcgcgcagctgaatttgttgagttctgtgtctgtcctttatagcacctaccagtgttgcatggtggtgggtggcgaattgagctagaccatgtgtggttgaagtgcagtttgcttatcctaagttactcttgtttatagggtaagggataaaaagcatattgattccttgaccacatttcattctcaatttaattatgacactgcatgctagtcccaaatttgtcagcttgctttatttttaagtcagtcttcgaattattacaccgtgaaaaaatagatcaagtaactgaattagagggccaaagctctttgatgaaaagtgcaacaatagtgcttctgcacaaagtagtcttaatttcctaataagagttttacccaattgtaagactcatttgttgattttaaaagggccaaattccattatcataccataacagctactccagaaacagaacttcctcttcctgttgatgctttccagcatcacatgaatgttcacttaaaagagtctgttaaatatttaaagtatttatatttactctttgtgtatttttcaaagtgggttttcattttcaatgaaataatttttaacttttccaagaatacacttaagataagtattgacaatgcttatcttactttcttctggttatccccatttttttcctttcagggtgttttgcttctgagaaatcacttttacgggtgtggggataattgttttcctgcttcattcaattctcgctctttctgttgagcctgtaaacaaaagtcttgctaggaactaatgtaatgttggttttcattgcgatgctgaggtgtttaatttatggaaacagaacggactcattccacacacaagtgagtgaaaagccctcaagtaatggtttttcttcagcattgcttctcagggattttccttgtcttctcgttatcttggaaatagaatcttggaatttgtatcctctttataacgtagatggcatataaacattcaataaatatgaaattactgaaagcctgtttcttttctttttcttttttttttttttttttggccaggcactgtgcaggcacaagagattacaaaatgaatattgtaagattaatctgcaaattggtttgggcattaatgttttttgaactggttcaggtgctgctgcctaattttacattttttttttttaaagaaaagaccttggaaagccaattaataagcactgctgagacctgtttcgtaggatttttttttactagggtctttttttattaagaattattcttatttgaccacatttaaatatattttgtaaatataaagcatccatttgctgttaagagagtagttgttcctaatatgaatatatgttggggtgaaatctggaggtactggtttagtattatttctctgccaaggtgtcttaacaaagttacgagtatataatagtttctagctttctgtcagccctacctcatccttttttcgtagtgtctaactcttactgtaggtatattttgctgactctagaactgttggaaaattaacagcaccagtgtagctttttagatagagatcctttcaagtttgaagtgctgtatgtggtatggctttgtttcgtagagtgtgcagaaccaccaggccagctgtgtgagttagagttctttcattgtggtgcttctgactacagagtctgtctgtcctcagttgaaatcagactagctggttttgggcgttgttctgttttgcagtttgtggcaggcgacacatggctgaacaagataagggttttattcttgtgttagggacgtgctggggctgggatggaattcagctatgtttaggctctgattggtcactttggatactcagaactctgttacatcctgttattattttgcagttaaatcaacacattaacttgctctcttctctttcccttcatcttttactccccagtccgcaccccttaaaacctaaaactcaaactttttaaaagactttaaactcaaactatgttcatggtagctattacttctatgtagtatatccaaacagctttaaaaaaaatggtaagcaatttatgagccctggagtctgtagttttcatcgtttagaatgagcacttgacaagtgtagaaatgtctgattgctgctttttagtctgcattgattgctgcattcagtcttaaaatacatcctaatcgtttccaatcctcctacatgtctttcttgtatccctgagaatttaggggtcctatagcaattggaatttcttctgagaggtagacaggagagaatgcccttttagtagactcagtaaatgatttcaggccagtgtctataacattgaattttcagggacagtacaggtaggaaagttatagggttcttccttgaaataaatggacttttgttttggctagggcttatgaattttgtagtttttgatttatagataaagacaggtttttgatacaatttttttaaagcactgaattcagctttgagctgtttaacttaagcagatttttaaagtgagtgtggaaacctgtgactttatatgcctgtacccagtaattaatgatacttttcattagtgatactttttctgtcaaaattgctgtataatggttttgattaaaaaaaaaagagctactcatgtttatatgttattttcaacgttgcatgagtcatctctcggcaaggtgaaattatttgtaaccttttcttgtaaagtcagccagtccataaatacaaaattgaaatgggggccaaagatcacagtgttagttttgtattcagttttatctttgcctttttagttcagtataaaatcttgagtcataaaggtatgcaatagtacattcacttgtacagttttacatgagtcaacatgcagaatctaaagtaactttttttgaaagtacagtgttgtagtcttcctgattaatggtacatttatatgatgttcatattcagtaaggtgacaagagaagctttatttgaaatcattacaaaaatatgttaaccttggaataccacttaacacattggtggtttccggttgttaacatgtatataccatcgagttaacatgtaggtttttttcttttttgagtcttgctctgtcacccacggtggagtgcagtggcgtgatcccctcactgcaacctccgcctcccaggttcaagcggttctcctgcctcagcctcctgagtagctgggattacaggcacccaccaccacgcctggctaatttttgtatttttagtagagacggggtttcaccatattggccaggctggtcttgaactcctgaccttaggtgatccacccgtctcggcctcccaaagtgccgggattacaggcttgagccaccgagcccagtggttttttttgttgttgctgttgttgttttttaactaagtttgagttttcagtttaaaaaatgaaatttgaggcaaacattcatggaatccataaatggtgaattttacatatgtttctgtggagcattgcgattccagggaaaacagttggaaaatatttcattgtacatatgtggttgcctcttctaaatgtcatccagtggtgggtatgaattgcttcccaaactgatacgggtcacagaaacagcaagataacatactggttcccagaggtaattgaagggactcttttgcatcatggttgtctgacattattagaaatgtttcttatatacttgcttgtttcctagaaattgaccatgacacattttcaagaatagtagcttaacttcttttggtcttttctgttaaaacttggttttgatgatgttcctgagctttatttgaagacatgctcctttcccttataataattacaggttttcaaaatagtgccatgtgagttaaaatttttaaatcaacaaaattatatttttgccttcttttgagtaaaataccatcatgtaggtaatgatatcctgtggtagtataattctttaacatttacaatattttcagttcagtacagggcagatcatgcttctgtcatttacactttaagctaattcatacagtttaagtcaagattttaagtcaagattataaaactagaaagggcagacccaagattttaacctagattttctggctctcaagtcccccattgttttttttcattttaaattattgtctttctttgtactgtatttttctgtgctattttcctttagtaactctccagcttgatgaagtcagttggatttttctcttacagcatagtttctagtaccttacccattctaattttaaatatctcttgaggataaagcttttgtcacttcctcaggagactgaagcacagtctgatagatcttgctgtcaggaagtttttcctgatctttacgtctaacttttcttttaagttgtcctgttacttgtatgtacttgctgtaccaggctaaataatgctctcctcccattttatgtttgtatgattctaaatgtttcagacggttattcattatcctttccggtccccttcccttactctttgcttagccaagctgtatgctttctgttgatccattgtctaaaaatcagcttatcttaatatttcattagctttttctcagttgctctcctactgcaaaaatatgggtaaagagattctcaaggtcattttgattcacttttattttagatagtctttaggatggatatgagatatgtcacagtcaaatgaaacaaatttatacaaacagcatgattaccaaatcaactaattaagcaattactcatgttctaaaaggcttttttacaaagcgattctttcaaatatgagtaccctcaatgtaacaaatgttatcaattctatgacaaaagggtagggtatagaaataatgttagccacctttgatggaaaatcatcttgttgcaatatgatgaaatacatcaggaagttgtttcttattttttccagtggtttttcagttcgttatcttaaattgtaggtcaaaacattcctcgatgtttggtttatttttaccttattgttttgtctcctcttatttccacatgttagtgaaataacaatgcttagcagtattttttttttcagtaaaatggatattgtgaaaattgaaatattttactttcttgctgttgtatttacaagaattgttaatgacaagacagtgtaacagaaaaagtgcatatttagattattataaaatctgtaagactgtagaccttttgaatactttattagcatattttctttagtactattttagtttcaaattattgagatagatgtccttgttttgtattttgctaatattaatattttgtattttggtaatactaaaatttgcaaacatgccaaatttagagcattttactttttcaacttagaatatctggaatcatcaagatagtcatatagggaagaccgctataagacagcttctaactccaatagaagcctatgaagctagtgcctggtcagaggctgtgcctaaattgcatgagtatatagtgtcgacttttagtaaaagaaaaaatacactaactttacctcttgaattagcatgcaccaatgcagtttagattcataccgaaacaggatcttttactaattcaaatgctgagtcctggtttttgagatcacagtcacatgacaggcctgggtggcttctcagtgtctagagacaagcaaatctactggccaatgaaaagtaggtttcctgtcttggactgcaagtaacaattcatgcagaaattggaactatataagagagcctggttttagttaatgctttcaattagctgcttgtcacactgctttttcttttggtgttatataacacattagagtcatttaaaggtacactctgatactacagtttttgtcaaatattacatataaatgttgattttacattcatatactcaaaagatcaaagaggactttgtagatcttttatggattcaaaaaaatgtagattattttgttgtagaaaaactggccaggcgcggtggctcatgcctgtaaatcccagcactttggaaggctgaggtgggcggatcacttgaggtcaagagttcaagactagcctggtcagcatggtgaaaccctgtctctattaaaaatacaaaaatgagccggaccaggtggcacatgcctgtaatcccagctactcgggaggctaagacaggagaatcacttgaacccgggaggcggaggttgcagttagccaagattgcaccactgcactcctacctggatgacagagcaagactccgtctcaaaaaaaaaaaaaaaaaaaaaaaaaaaaactggagacttcatcagcctctgaaggaatgatacctgaaattgatcttgtaatgcagaaagtggctatatgttatccagaagagtaacagataccccaaatacacttgctaacacaagaaatcctgtgaaggtgcttagacatacccttccatagattttagatgggttatctgcctatgttccagacacaagccgatatgttgtggtttgcccagtacagtctctgtggtttactgagaggaagtggttcttgtgggtgaaggtctgatcttttcagagattgttggtggcatatgcactgtcagcctatttcctgttttattggctgtttagcaagaccttcttagggcaagtgctgctgaagaggtatttaaatattttgtattggcaggatagatggttataatgatgtattattatatcactacttctcaggtgatatgagagttaaatgaatgtttgtgaagtgctttgagatcttaggatgaaaagtacagacatgttcttagtcatttgcaggttactgctatgttcagatattgctctcttgaagttaaaacttgttcatgtagtaaagtgttactctattaaacttgatttctgtaaccattcaagtgttgttttatcaccacaagagtcatgattagaatttttcccctttttttcctttctttcaatgctcctttatgattttaccctagaagagtttccttaatagattccttgctctagtactggttaaggcatatttaccaaacttaacacctagcaagcttgtccaacctgccttattttgctgttgttcttctgttttgttttgttttaggctttcagcagcctgaagccatggtttttagtttctgtctctagtgataaaacggaaagagggatgaggaaggggctttactggcccatccagaaacagaaactaagaacccatgactgtattctctcccttgaacaactgtaactagagcaaacctctttgccaatttaactggcatactaaaataatgaaattgtgagaatttcctttgagattagtaactgtaccatccatatacaaaacactatattgctttgctgaaacctgaaagtgagcaaactgatagaaatgcatataacaggccgggcgtagtggctcacgcctgtaatcccagcactttgggagaccgaggtgggcggttcaggaggtcaggagatcaagaccattctggctaacacggtgaaaccccgtctctgctaaaaatagaaaaaattagccgagtgtggtggcgggtgcctgtagtcccagctgctggggaggctgaggcaggagaatggcatgaacccaggaggtggagcttgcagtgagccgagatcgcgccactgcactccagcctgggcacagagcgagactccgtctcaaaaaaaaaaaaaaaaaaaacgaaatggcgtatgtcatactcctaaatatatatatatatacagtatttagccttggacgttaaaaaaattaacaatgaatgggggaaggctttatttaaagctaaattgttagctaatacgtgagttcttcaagggtataagaatagttcttattcatttttaagtaattatcggtagccttattatatttttattttttaatactgaaaagcagaaggaagaaaaataaatggcccaaatgatccaactacccagatgttgctgctcaggttaaacgcacacacgcatacacacacagaaaattcaaatcatataaaatggtataaaaaaaagtattcctacacacctgttagttttcataccttctcctcataggtaacaatagttaatttttttggtttatcttctgaaacatttaaaaatatataccagcctataattttattttttgcacctactccataataagtgtatctgtcttcttttgctaggttatgctgctgtagcaacactatcaaatttcagtggcttacaacactgcttttcttcttgcttatgctacaccttgtcagctgtggattgactgcagcattgcttcacgtttcttattttggaaccctggctcaaggagcatcccctgtctgggctgtgccattattgtggatgagggagagagcaagaaaacagatgcagacatacaatggctcttaaagctttcactcagtcatgttgtatgtcacatcagctcacatgtcagtggccaaagcaagtcatatggtcagagctcactgtcagtggggtaaggatgtatagtccttccacaggtggcattgcaagttgcatgataacagataaggctgtataatcctcttaaggaaagtggaggttaaataatttggaacaataaataatatagtctacatcaacaagttcagtaaatgcttgttaaatgggttatttggagtctatgaaagtttctttttttttagtgggaaattcaaacataaacagaagtacagagaatggtatgatgaacctcccttgttccctttattactccagcagttaatgtacggacaatcttggtttatctgttttctttccccccttctcactagattattttgaagcagtttttggatatcataatttcacttacaagtatttcactaagtatttttaagagataaagtctgaacgtgtgacttctcatagtaaattattactgtctgatagggtgaggtaatagtactatatagactgacaggtgtcaagcagcagagcacgttcatagagcgtatctagaatttgacagcctgaacttgttttgatttcattttgagtatttctggaggaggcttacaacagaatgccatctacttttccagcctctccctttctttctttctttccttccttccttccttccttccttccttccttccttccttccttccttcctttctttctttctttctttctctttctttttctttctttctttctctctgtctctctctgtttctctctctctctctctctctgtctgtgtgtgtgtgtgtgtgtgtgtgtgtgtgtgtgtgtagcagaagcaggtaattaacctctggaaaaaataacattgcaacagatttgatttgcagaggtttcatttctcactgagcctctgttggaatgatgccagttgaaaggaatcccagctcttaatggctccaagtcttctgggagctctcagtgatgttattttctttggagaagaacatcagaatcatttataaaaatcctgtgttcacccatgccatttgctctgtggagaaaggatctatcatatctttaagatgatctctaagatgatataaaagtaaagaaattcatctatctaattttagtttagaaatcattaatgccaatttcagctgctcaggttagtttgtcttgaaggcctgaaagcctccattttgattcaagatgtcgtagattttatgagcattcagtataaccagtaagtttgtcatttccatggttgtagggaatatgagacattctgttatggatctaggattaccgtttcacaggacattctttttttggggggattgttaggtaataaacagtgggacacaaaataaacagatataatctcttcagtttgtagattttcaggtgacaatgaggtggcagaagaggatttgtgcagattaggaaataaataattattgtatataacatgatggaaatattttagtatagtaccactatcaaattaattttgtttccttaactagcttctttcattgtgtacagagacacttatattaaagtagtctttatagatatccagttagctttagttttttctaattacattatattgctagtctcatttcagagtccatgtaggaactacagtagaaaagtagctatcattggcttgtaaataaaattacttaattttgagtttttcttgggaaggaaaaaccagttttacagaattagtggagttgattctggttttggttacttgtgacaatatagtctatttaaaatataaataaataaaaatttgcccaagaagaataagtttgacttgccatgattcatactgtttttctgttgttgtatcacaattgagaacattagtttcagaggtaatagtttgtcagtatgggtcgagtagctctaatccaaaaatccaaaatcagaaatgcttcaaaatctgaaactttttgggtgccatgtgccacaggtggaaaattctacacgtaagtacataatacaaactttgtttcatgcacaaaattatttacagtagtgtataaaattaccgttaggcgggggccaggcatggtggctcaagcctgtaatcccagcactttgggaagtcgaggcaggcggatcacctgaggttgggagtttgagaccagcctgaacaacatggagaaaccccatctctactaaaaatacaaaattagctgggcatggtggcacatgcctgtaattccagctactcgggaggctgaggcaggagaatcgcttgaaccagggaggtggaggttcaagcgagccaagatcatgccactgcactccagcctggaaaacaagagcaaaacaccgtctcaaaaaaaataataataaaaaattaccttcaggctgtgcatatagagtgtacgtgaaacattaatgaattctgtgtttagacttgggtcccattcccaagatatcttactatgtatatgtaaatgttccaaaacacaaaaaaattcaaaatgaaacacttctggccccaagcattttgggtaagggatacccaatgtgtacctttgttaggataatatacttgtaccttggttgtattttagttgcaattgttagttgcacaatttgggggaatgtttgaggtctctatagtagttactgtatttaccaggaagccctgcatgattagaattcttgagacagtgtataaagttaaattgggtgtgttgcctggatgtgaacagtaaaaaaggagaagcttctcaccatacaattatagcttaaaaggaaccaggtacaattctgtttccaaaaatagaaagtaagtcaaatattatatggatatgtaatagtaattatattaattttgactccctggccgactttttttttgaagctatcattttttgtcagagataaaaagtagcttttaaaggaaaagatatctcagcccttaattatgtgtgtgtgtatgtgtgtgtatgtatttatttatatattttagcccttgtaagagaggagcagtggaagggaactgaaggagcatgatatagagaaaagagcctgggttttggtgtgttgcatttgttctgttactagctgggagaccttgggcaaatttacctctctgatcagcagtttaattttttcatctgtaaaaatgggaagaatacctactttgcagaattgtcgtgacgattaaatgagagtgtgtgtgagtacctagcacatcgtaagagagagctcagtaagttatagtagctgttattgtttaaacttcaggaattagctaggttttgctagaactttcatctgtgcttgtaagatctttttgaatccatatgtatttttagcagctgtggctaagatagtttttttcccttgctgtgataatattccttatcttttatatttcaggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagttctgtatttattaacatcagtttgtttatttattcagtaaatattgaatgcctgttctgtgtaggtcattgtcttggcagttattttgagctcttgctacctgctgaattatatcttaaaatgaagaaatttacatgatagagtgatatttattcatctgtgctgaagattaaagtgagaagtatgtggcaggcgcggtggctcacgcttgtaatcccagcactttgggaggccgaggtgggcggatcatgaggtcaggagatcgagaccatcctggctaacacggtgaaaccccatttctactaaaaatacgaaaaattagccgagtatggtggtgggcacctgtagtcccagctgctggggaggctgaggcaggagaatggcttgaacctgggaggcagtgcttgcagtgagctgagatcacgccactgcactccagcctgggtgacagagcaagactccgtctcaaaaaaaaaaaaaaagtgagaagtatgtgtatttgggggaagttgtagaatgaaataataatgattaaattgatcttatttccaaattttaaaaatgtggttactttctatcacatactgtctttttatgttttcctttttattttatttttcagtttagttatatttcagtgaactatttagaccaaaatggaaaagacattggtgtaagttggaatctaagaagttttagatgttcattgcttttgaacagaggaagtaacattttatggattgggcattgttttagtcactacttgaaggagaacctcttactcattatcagtctcttggaaatagcaactgattaagcctatatatactttgtgcatccagtgaaaatgtgataaatatgatgatcttttggtcagagaaggattctggaaactgcagtagtttgattagtaagacagtgtttaaatcatgattacttgttgctctaatattttagactttgaaagatgacaagatgtgatgtaggtgacaaagagcatttttaaaaatgggtgaaattggccgggtgcggtgactcacgcctataatcccagcactttgggaggctgaggcgggcggatcacaaggtcaggaaatcgagaccattctggctaacacggtgaaaccccgtctctactaaaaatacaaaaaaaattacctgggtgtggtagcaggcgcctgtagtcccagctactcgggagactgaggagaatggcatgaacccgggaggcggagcttgcagtgagccgagatcaccctactgcagcctgggcaacagagcaagactccgtctcaaaaaaaaaaaaaaaaaaaaaaaggtgaaatttaggcctatcaagatacttgggatgtaggaaaggaatatatatatatatatatatatatatatatatatatatatatatatattttttttttttttttttttttttttgagacaaagtctcgctctgttgcccaggctggaggctggagtgcagtggcatggtcttggctcacttgaacctccacctccctggttcaagaaattctcctgcctcagcctcctgattagctgggattataggcacccgccaccacgcccgtctaatttttgtatttttagtagagacggggtttcaccatgttggccaggctggtctcgaactcctgacctcagatgatctgcccgcctcggcctcccaaaatactgggattccaggcatgagccactgcgcccggccggatgttacatttattgagtacatattaagtactgctcactgttttaggtacttcctgtgcattgtcttttttaacctttcaactaagctaaatactgttgtccctgttttaaaactgggaaaaatgagcctctgagaggttcactaatacccaagctgacatagtttctaaacagaagacttgggattattactccgatgctcgcttttttgaaactactggtcacagtcgtttgtggttattggctcatctagatcaatcaattggatgaaacccagaaaatagattttgtcttcaacaataccattaaagagttgccttcacattaaaatttaataactacatcttatcctttgtactcttaatcacctgttttccctattttcttttccagatttctgacatgagggattttgtctcatttgctctaaagagtgaacctaaacattgtgtttaggtttgttattagttgctttaaatatatacacatctgtaaacattgaacttttttgatgcctcatctgtgttgcttatagatcattttccatcataattattttaaagtccttttaagaagtttaaggcctatctcatatatgtaatatattaatagtagataatcaggcctttggaagcataaatgatgtaagtaagttgggttgcagttttttcttatcaagaatctgcgtgtgtttaagtggcagtggagataatatttttatttgcgttgttatagtgttatctttatcatttagtttatattttctgccatttaaagataaaaaggttttatcttttatagctatagagtcatcttctgagccttaaaacacttgtgttttttttcttttcgccgtgtgggtggggaaaggggtgtgtggcaatggccctgtgctttgcctctgcctgagttacaggcgtgctttgtttgcctggctggggtttgtgtctcccatgctcaggagggtggaaccagtttcccagggcctgggccctacctattgtcattctccccataaggggatctgttacgtgtacttgtgggaccacacagtgctctgggcagataagcctcttcctgcctatatcagaaccaacatagcccacacacatctgggaaagcatgccagggtcagcaccccaggcgccctgtactcccagcccattccccttcttcttcccactcacctggaatccctgacccaaggctctacctattggttctaatattctggtggacagaatctaagagtccagcaagctcagaatctcaggacctcctcatccctttaggaaccatcaattaatctcatgatttcaggttgaaccactggagtcaatttcagaagttttggtctatctcagaaccttcagatcacactcaaaagcttggggacagcctcagaaccttgggacacatctcagcatacagggtcatcaatcttagaacttgaggtctgtctcagaaccttcatgcgaaactcagaatcttgggaagtcccaggaccttgtgcccggtattataccattggatcaattatcacagtcgcagaatcttgaggtccatcttggaatggtgcagtcagcctgaaccgtgggatcaagttcagggacatgagaacaatctcagaaacttctggccagtcctaggtctgaaaaccttcaaaacagcaacagactcttgcggtccatctcaaaacttgagattgtggtctaaaagggaccctcaagactatccatccagtcccttcctggaatacaagtcacctccacagcctccctgatctcgctgtctagtctttgctatgagccctcctcgatagggatacctggcccctacccactgcctgccttgcttctggatggctccagctactaaatgatgtctccaaaatgtgagaatctgaaatctgtctcctttttcccacatcagccctctgagacctctgcagagatttcaaggcaagacccatatgctcagggtaagctttgtcccagactgcccacactgggttcctcccctgacttccagatctccacccgcccttctgaacactgttatctgcaacacagttacctgtttatgcatttcaattttgagcctataggatatctcatactgcaaaggaaaagcccattgggaatgtctggggtggaggtggatgcccaaccctgtgctgggtgatgctgggggaatcacagcaggatacagagccccagaaccccatggggtcccagaggaggagcccagaggaggaagcgggaccatacctggaggggctgcctctgatctcctcagagactaggggtgcagtgggaggagaagataggagatgcctagagaccctggccccacagagatgcctgtgagaagagggaagattcctgtttcactattctcaagagctgggagaggcttctgagagagaacctgtaatcccagtcggcccaattacagataggaaagataaggctcaaagagggctcagtcctaccccagagtggttgggtgagtcaggactaacaagtcctctttcccattcccctgacatcataactctccccaccatgatgttatgttgctgcatttcagtcttctcactggccatcttctcacattccagcttgacactaactaggaaggagagagaccatgggggtcccacacaccccatatgagccaaagtgaaaaacattgttacttttaatctcatttcttctttgtaaatgattttttgtctctgaaattctgtgacatgaatcagtttagtcactttttatcttattaaatggagagaaaaattgcttaagagatatttaggtgtgttgttttttaaccctttttggttgtaaattgttttctttctttgttttagtaaccccagaaaatctagaagaaaatctagaagagaggtaggcagatcattggtttaaaaaaagaagcccaccaactaaatcttttattgagtaaagtattgtttctaggtagagaaagattagagaattgtattgagaattttactaggtttgggatttacaaagaggctaacatgcaaaaggcagtgctcttcgaaggagtcgtatagatgtggagactttatagcccttagggagatctacagacatccgctatgctgagttctgggaagctgctttttcccatgcttgcagcctccccgtggggtaaaggtctgttagttttgcataaatatttaccatatctcattttagctagcattgcttcctcacactgttagcactaaggagaactttgcttatccagcttgaaaaatttactgtgatcgatatgactaatctggaggatgttctgtcatctttgagcattgatgaagttaaaaagtcagattggcaaaaataatgagggggaaagcaaccggttcacagttgacaaacatttgcccatgcttgttttcccatatttatttttttaaacgagaaggttattacacaagcagcatttcagtcttgtcacacccaataaattattgttgcttttatatgtttatttgtatactagtcgtttacatttgcatttactatacttttacaactgtttccttattttgtaaccatgaacaccagcttctacatgtaaagcctcattctaggtactttatatacatcatatttaatagatataataattgtacaaggcaaatgttattcccattttacagatgagaaaaaaacttagattcaaagacattgattgactagatcagtatttcccagctataaatttttttggaaccaggttttaaattcaagtcttttagcggggcacagtacctgtagtcctagttacttaggaggctgaggtgggaggattgcttgagcccaggagctccaggctgcagtgagctatgattgtgtcagtctacttcagcatgggctacagagtgagactctgtctctttaaaaataaaaaataaaaaaacccagatctttttgactcttgattcattacatttgctactgtacccaattttatgttactccaaatgaaaatattcagccaaagaaggttatttaatctattttaagataaattacaggagtaatttctaagttgtgttacagggaatatccaggacactttaataggagtgtatttttttgactcatgagccctacaacattcaggcattcaaggccaaaggtagaatgtaaaatgatattaaaaggcaaccttcagactttgagtttattattttaaaaaagatccagcttattatggaaaaatggcctaatccattttattagtcaaaaacaatccaacatttgcaatttcatgtgattcaggctaggagcaatctatcagtatgactgcgtcttaaatcttgtcaatatttgataggattctactttaaaatttttgtgtttttgtgtctcttaccttctacttctccttcactccatgtcttttttaaaattttttatgtttttgagaccgagtcttgctctgtctcccaggctggagtgccgtggcatgatcttggctcactgcaatctctgcctcctgggttcaagcgattcttgtggctgagccacccaggtggctaggattacaggtgtgcgccaccacacctggctaatttttttttaagtagagatggggtttcaccatgtttgcccagctagtcttgaactcttggcctcaagtgatctgcctgcctcagcctcccaaaagagctaggattacaggcctgagccactgcgcccagcctccccttatctttttgcatgtacactttgtctttattgtcatcactaagcttttaatctttcctttgttaccccatctaggtcctctgctctccctcaaccttttacttatttctggttgagcccttttgtcattccctgcaattttctgaccatgtagtagatacccagtaggcttcctggattacttggtttttctgtattttgctaaaaagttactccaaagatgataccttctatttggacctttcccaccctttatatacctatctaggaggtagtaacccaaccattaatctctccatgcaaaatacatgtattgactaaaaattatgtgctaggtactgtaatgtttcctacccattattttacttaattctcacaattactctgtgaggtattcacaggtgaagaaagagaaagtttaagtagcatgcctagtgagtggtaaaacttggattttagtatgaatctgtctgacttcccaacctgcactgtttttttttttgttttgttttgttttttttgagacagtcaccctctgttgcccaggctggagtgcagtggcgtgatctcagctcactgcaacctcagcctcctgagtagctgggactgcaggcatgtgccaccgtgcccttctaatttttgtatttttagtagagacggggtttcaccatgttggccgtggctggttttgaattcctgacctcaagtgatccgcctgcctcaacctcccaaagtactgggattacaggtgtgagccaccatgcctggccccagcctgcatgcactcttaaacactatcctatactgccagatatggtcagagttgaatcagatactgtttctgccttttaggaacttcgagtctaatagaggaagatagagaactaagtgcacagggcacagtggagactgaaaggagaaaaatcattactttttggacagatcacagacagcttcatagaggagatgaatatatttgctgaatcctggaatgtgggatgtagttactggacaggtaagggatagaggaacaattcaggtaaaagaaacaatcaggtttttttgagacagagtctcactccatcacccaggctggattgcagtggcatgatcttgcctcattgcaacctccacctcctgggttcaagggattcttgtgcctcggcctcccaaaatactggaattacaagcacgtgccaccgcagctggctaatttctgtatttttagtagagacaaggttttgctgtgttggccaggctgtccttgaactcctgacctcaagtgatccgcccacctcagcctcccaaagtgctgggattacaggcgtaagccaccgtgccaccaaaataaggaatattaataaggacatagaggtgaaatagctcacattttcaggaactgcatatagttcagcatggctagagcatggaggttgatgatggatgggcacagcagttggtaaagttggagtgataggtggtaccagattatggaaggccttttaagtcattctaaggagtttggattttaacctctggattgtagggagccactgaaggccttcagtcagagaggcagtaagcgttatgttataaaagattctttcggtggtagcgtgaagaaaggattagtcttgagcaacagtttcaggggcagagaaaccaatagtgagacatttttcagtaatccatatgaaaaatgatactaataaattcctaaactgaagttgtaacatatacttaaaagcgaagagacaaagttattaagaagatactaagaataccagcagggtgaaaggtgtgtggtcaaagtgtggggctttctgggttgtgtccttgggtaggggttggtaatacttagcaagatagggaatgtaaaagggagaaggcagggttttgttttgttatttttgtttggctgactgataagatggaagatggagaagagaacagacatagtaagggatagatttagtttaagttactaaatctttagtttaagtattcactatctgttgtatgatagattatcccaaaacaataaacttgcactatccactatggtaaccacaagacaaatgtggctatttacatttaaattaattgaaattaaataaaattgaaaattcagttcctcagtgacactagccacatttcaaatattcactagccacatgaagccagtggctacagtactgttggttgatcatagaacgttttaaattattgcaaaaagctcttttggacagtgctgccaaacatttatcaacgcatagtttactaagatcagaaatcggtgagcaactttgctgggtggttctgcttcaaggtttctcatgaggttgcagtccaggtgtctgcaactagaagcaagggcttcaggaatctgaaggctcaactgcacctggtgggtccatttccaaggtgacttactcatgctggtcaagtgagtgctgattgttggtaggaagccctagctcctctgttggtaggtggacttctctgtggggatgtgtgaggcagctggctttgccctgagtgagtgattttagccagagagggaggtagaagccattataacttttgtgagctgacctcaaaagtcacactacatcatttctataatctgttggttacacaggtcagcactattcactgtgggaagaaactatacaagggcatgaataccaagagtcaatggggcccattttgtttttttgagataggatctcactgtgttgctcaggctggggtgcagtggtgtgatcatggctcactgcagcctgaatctcccagcctaaagcagtctctcatctcagcctcccaagtagctgggactacaggcatgccaccatgctcagctaattgtattttatttttatttatttatttatttttggtagagatagggttttgccatgttgcctaggctggcctcaaattcctcggcacaagtgatctgcccaccttggcctcccaaagtgctgggattacaggcataagccaaagtgcccagcctattggtggtcattttggaggcttcccaccacaaatacttacggaatatctgggtacaaatatctagtggacaactaaatgtataggaatgagttcttagctagtgctattatatttgtgatggtagttgaagaaacttgaataggtgtagatcaacaaggatgagattgaaccagaaagacagttaatatagtatcttgggtcacatgtttggggaggacagaagtactttcaaaggctggaggaacagctacaggggagtagtagtagaacaggcaggggagtacattataaaggaaacttgaagggatgaaagttgaaagtagaatgtaattaacattgttcagtagttaaataagagtaaaacttaacagagtcattctttcaaaaaatatttcttgaatacctgtgtggggaaccagagaaagattggtagataaataagaccaagtctctaataacacgtaatactatctgaggagacaagtttgggaaggtttcttggaggaaggtaatattttaaggtagagactctttaaagggtaaggaggtgagttgggtattttaggggtgtggtggtagagatatggatactaaagtggacatttcaggctatgttagatgtggaacactgctaggatatgaagttttgtgatgagggaaagtggtgagaaaagaggctggaaggccaattagagtagtcttgaatacatgcatgttaaggaacttgcctttatcctgctgactgtttcccatacttaaatttggatactactttagtgatttgccataggcttataacccctaaactgtaagttactaaacatttttctttaatattactctttattattttatttatttattttgagacaaggtctcactctgtcactcaggctggagtgcagtgatgcggtcatggctcgctgcagccttgacctcccaggctctagtgatcctcccacctcagcctcccaagtagctgggaccataagtgcataccaccacattggataatttttgtattttttgtagagatgaggtttcaccatgttgccccaggctggtcttgaactcctaggctcaagcgatccgcctacctcggcttcccaaagtgctgggaattcaggcgtgagccaccatgcctggccagtaatattactttttaaacttagaaaccatttccagagggaacttcattgtattgttataaatagaaaaccagtattgtttgctacatataaaagagaatagaaaaaatatgaatgattattacgttaaaaaaattaaaagtggaatgtagcaatgcatcctttgatatagaaaaatgcccacttggaaataagttcctcagtgagaatactatttttggtcagttagcaataaaagggcctttgcttgaatagtgtttggtttctacctaagatgagattttaaggtcattaagacaattccatttttaaattttgatgttaataagcaccaagaatcacaactctcaagtctgcgtacttggaaagatcataatacagttaatggtcaactttgtccaactttattgttaattcaagcactaataaaaattaagcccttttgttccaagaagccatctaaagtagtttatagcaggggtccccaacccctgggccagggctgcacagcaggaggtgagctgccagggcgaaagagcattactgcctgagctccacctcctgtcagattgctggggacgcattagattctcataggagtgcgaaccctgttgtgaactgcacatgtgagggatctaggctgcacactccttaagagaatctaatgcccgatgatctgaggtggaacagtttcatactgaaaccgtacgtacactcaaatccccatctgtggaaaaattgtcttccactaaatccgtccctggtgccaaaaaggttggggtctgctcatctatagaatctattcttctgagtgtgtcaagttatttattggacatctggaaatggagaagggattttttttgtctactctttgctgccatccagtttgggaaaattctcgcaaaaattttcaaaaatttcaagcatcttttacaattttcgaaatatttccagtgagtttttcagaggaatccttaactggtcctttcagagaggaaaaaagtatccagctcacctacatatctcatagttctagtttcacatttatcttgttcactttgttttgtacgtggaatacgtaaacttgtcaggataaatttaggttgttcacataagtagatatatttgtcaagatatgcttatttgcagagcctgtctcaggcatgcacatgatctcacaaactgaagatttcttccagaaatatttgaaatttttcctgcagctcaaaaggatgcatgaagagttttccactctttttgccaaactctatatgtagccccaattttgaagttacttttataaggttttaaataaatggttttgaactgtaatgactaacaaaaggcatgtgaatgatagtgctagagatgctgccaccaaagtaccaagaaagaatatcatgcttgatgataaaataaaagctttggagtgtctcaaattggctgaatacatttaatgagctattagaggaaacatggtaaagatggatggtcatttagaaattctaaagtcctgtaatgttgaggaagctaaacattatcaaatcttggaagaagtaatcaatataggaagaagaaggaggagaagcaatactttggatactaagcaatagtttcaatactaagttgaaattacttagctaacctcaatttaatggactcactacatttcctctgcagaacatgacttttacccagtgagttaaatgcttgtgtctcatggctattttgtagtgtgtctgaatgcttctacttcgtccagttgaattgtataatctcaacccgttgtacttgaattggaattagatgatttagttaaatattatgaaaactgaaaactgatgaaatctgagcaccaaaaagaaagttatttctataaacagtgagttgtgtgtgctttggaaataagagtagagacttgtcactgaaaaaaaattctgtcaaattagacgtgtatacaaaacaattattatttggaaagtatcttctagattattatgaatgtctttcgtttcttgctccactctaaggaaacaggaaataaatcatagctgatatattttaggacagtttataccagaaagctgatgggacactccaatcaacagacccctacttaaagaaacagccaggcgcagtggctcatgcctgtaatcccagcagtttgggaggccgaggcgggcggatcatgaggtcaggagatcgagaccatcctgactaacacagtgaaaccccatctctactaaaaataaaaaaaattagccgggcgtggtggcaggcgcctgtagtcccagctacttgggaggctgaggcaggagaatggcgtgaactcgggaggcagagcttgcagtgagctgagatcgcaccactgcactccagccttggcaacagagcgagactccgtctcaaaaaataaaaaaagaaaaaaggaaaaggctttgatcctacattttaaaattggcaaatgaatgtacatttacataagttgaaataaagtttaaggtttgtatgaatggtttttaattatttcctgctttaactattcttttccattaaatgaccaaccactggtaccagtggattggataagacagttggcactgcgtggataaaggaggtttaaagaaaaggaaacatgaaatgccttctttttgaggctgctacaataaccaagttacaagtgtgctgattaatttattattcctgtttccagaaatgtcttatttgtatttcatttttaatatttttaaatttaatagtttacatttcccccactagtgttgccttctatttgtagcaagttaatactggttttctatttataatagtgagataaagtttcctttggaaaggaatgttacctttaaagaaaaacattaggtgactaataatttggtgcttatgtgactgtggcaaatcatgaagatagtattttaagtatggaaaacaattgctaaccagcaagataatgtcaagttccttaatatgaactcacttcttggcctttgtctaccttctccagcttcatgtcttaccactttcccttattatggacttcatgttgatcaagtggaggctccctctcctcaaggagagtccctaggccagattcagaagatggttggtagagaggggatttgatagcttctgaggacagtgctttggatggagaaatatcatgcaacttaggacagtgctttggatggaggaatatcatggaactttagttttccagctttattgagctttgcctgtgatattcacttgtttggggggctgtttggagacagggtctcactacattgtccagacacaatcaccatgtactgcagccttgaagtcctgggcttaagtgatcctcccatttcagcctcccaactagctggaactacaggctcgagccactgtgcctgactcttactcacttttttgttcccaatacctggaagaagatcgtcagtctgtaaatatttgaaatctaaataagggttatggtgctgtagtataaggccaaatcttgggcaccaaacaaaaaaaaatttagaaaaatcccttagcccatcccatgctgtgctgggagcttcatctttctttttaattgcaatttaaacgatctactgctacaagagggttgtggtaaagcagaatttcttatactgtgcaggtgggcatgtaaattggtttaaacttacagaaaataatttgacaatatagttcaaaagcctaagaaatgtttaaactttttgaattagtaatgccaattttggtatatatctcaagacattaaggatatacagttttagctgtcattttatacaaagagatcacccacaccattattttagtaggggcaaagaggaaccaatgtaagtctggtgcctctgaagaggtagacctagaaactgggatgacaaggaactcccaggggactgctgttaataaattactttatgtcatttgataaaatatatgtaagcattaaagacattttcaagtaaaccttagtgaggaaattgttcatgatctgtgaaaagtatgggataaaacttcaaatataatgccagttacatttttaaaaaacattcatgtgatgcttttaaaaagacttctaggacatgtaccaattttttttttttttttttttgagccaagtcccactttgtcgcctaggcttgagtgcagtgggcacaatcacagctcactgtagcctcagcctctcaagtagctgatactacaggcacacaccaccatgctcagctaattttttaattttgtgtagagacaagctctcactatgttgcccaggctggtctcgaacttctggactcaagtgattctcccacattggcctcccgaaatggtgggattataggcacgagccactgaacctggcatgtactactttttaagtgtttctgggttgtgagattatagatgaattttgttttattcttcacactcatatgttgttttctaggcttttaactatgtgtatatatatatattgcctttgtcatgagagacacttttgtttttaagtgaaacctctgtttagtttttatttatttatttgatctttattttaatggaaaggtaactgtgctggtaagctgatagatgattggaaggaataattcttgagactaggaatgcaaatgaaagactgctgggagatatgagaagctcctgaactagggcagtggtgataggattggagaggaatatcgtgatcagtaagacataggaataaaggaaaaagagggatccaggatgactcccaagtttctgggtgtttaaatgtaatacatttgagatgaaagtttggctcttaaaaaatattcttatttggggaatgtttaaatttagtgaggtcattaacaacttcagattccttttatacttcaattctttaaattctatatgttgccaaagatcctacttctaatttgttagggttaacaagaagaaagatgatatgtctgtgaagacatgtttctgacatctgtcaccctatggattgccagttgatagacctggttgtcttgataagtattagctgactccccaaccagtttatttgcaccacttctgaagcaataagcttggttgaaaaagggcacctcccaagtagggaaggataatttttaggtcaaattatagaaattgcatgtatccctgttaacacttccaacaccaacaaaaaaatagacaggaaaatgaccctaccagctaattctccattataagactttgaagaaaaggttccattaaaaacagaaaagaggctgggcatggtggctcatacctgtaatcttaacactttggaaggccaaggtgggagaattgcctgagttcaggagtttgacaccagcctgggcaacataacaagaccctgtctctacagtaagtaaaaaattactggatgtggtggcatatgcctgtggggccagctgtttgggaggctgaggtggaaggattgcttgagcccaggagtatcaggctgcagtaagccatgattgtgctattgcactccagcttggtgacagagtgagaccctgtctcaaaaaaataaaaccttgaggacccaaatttgatttaaatttagatgtactatctgctttgggagagttactttattattatttagtagagacagggtctcactatgttgcccaggctggtctccaacttctggccccaagcagtcctcccaccttgggctcccaaagtgctggggttacaggcgtgagccaccaaccctgcccttaagttatttttttgatcttttcatgacatgctgtgggcaataaaataatacagtgggtgatctgttgttgcaattcaaatatggagttcctttttcttccacaaaagtattggctgatttctttctttttctggctgtgagcaacaggtaaattaacatgaccatggtctgtccccagcgtcttgactcagatttcttaatttgaacttttccatcttctccactccaagatcacatgacaacatccaacatcagtggatagaaataattagaggctggatgaggtggctcacgcctgtaatctcagcactttgagaggccgaggtgggcggatcatttgaggtctggagttcaagaccagcctggctaacatggcgaaaccccatctctaccaaaaatataaaaaattagctgggcgtggtggcacacgcctgcaatcccagctacttgggaggctgaggcaggagaattgcttgaacctgagaggcggaggttgcagtgagccgagattgtgtcactgcactccagcctgggtgacagagtgagactccatctaaaaaaaaaaaagaaatttaataagtcactgctacactggcaaagaagggttgagtagttttaagaagcttagttgctgtccaacagtcttattgcatctgattcttttggtgcttgcttactcaagtagggatcacatagcatgggaaggaaagagcagatctgtgattctgttgtttacatctcagaattgtggtttgtgaatagttttgaaatttttcttatagttttgggagaaatttgttaacggaatttttaaggattataggacagcacaaaataatttctcttgtttagatgcttttaataataaaaaaaatctgttaggatactttttccttttttttttttttttttttttttttttttgaggtggagtctcgctctgtcgcccaggctggagtacagtggtgtgatcttggctcactgcaacctccgcctcctgggttcaagcgattctcctgccttagccttctgagtagctgggattacaggcgcatgccaccatgtccggctaatttttgtatttttagtagagatggggtttcaccatgttggtcaggctggtctcaaactcctgacctcatgatctgcccaccttggcctcccaaagtgctgggattacaggcgtgagccaccacgcccagcctagaatactgtttaaatgataaaatagctgagtgcagtggttcatgcctgtaatcccaacactttgggaggctgaggcaggaggattgcttaaggtcaggtgtttgagactagccctggcaacgtagtgagaccctgtctctacaaagtaatttcaaaattggctgagagtggtggcacacacctgtagttccagctgtttgagaggctgagttgggaggattgcttgagcctgggaggttgaggaggttgaagctgcagtgagctgtgatcgtgccactgcaccccagcctgggtgacagagcaagacctcgtctcaaaaataaataaataaaagataaaataagaccgaaagatttcattatgggatagagaagaaaactaatatggaatttaagataatattcttatatttgagtggcctctttttttgagacagggtctcactcttattgctttggctgggccacagcggcatgatcttggctcactgcagcctggacctcctgggctcaagcaatcctcccgcctcattgtccatactgtctagctatctccatgataacaacatcatcttatatcatgactactgactaaaatccttagtagctgggactacaggcacatgctacaatgtctggctaattttttaattcgtttatagagatgggggtctccctatgttgccgaggctggtctcaaactccaggcctcaagagatcctcccaccttggcctcccaaagtgctgggattacagacgtgagccaccatgcctgacctgagtagcctttttatttaaagggaatcggcatttgtttattacctggtatgttctgagtatcaggctgtgtacttaacctcacttaatcctgacagcattcctataaagcagatacctaacaattatttgtgaggaaattaaggttcagtgactttccataaatttgcttatggtcacacaatccattgagtgcttgtgccaggttttaatctcagtctgaccaataccaaaactcattttttctatgtatgtttcccttttagaaagattttatttttttaattttaattttaattttttaacttttaggttcggggtacatgtgcaggtttgttatatcagtaaactcttgtcatgggggtttgttgtacagattattttgtcacccagttactaagcctagtacccaaaagttattttttctgccccctccctcctttcaccctccaccctcaaataggccccagtgtctattgttccctagaaagatttcataagtaaatgtcatctagcctgtaaattatttttgtttgccagcatttataatataggtggtcattctttaggtgctgaaacagaattggttttgtccttagtgtctggctgtctccaatgataacaacatcgtcttttatcatgactgctgactaaagtactatattctcaaatcttcttttcttctttttttttttttttttttctgtgacagggtcttactctgtcccccagtctggagtgcagtggcatgatctcagctcactgtagcctctgcctccagggttcaagtaattctcccacctcagcctcccgagtagctgggactacaggcgcacacccgcacaactggctaatttttatatgtttagtagagacggggtttcaccatgttggccaggctggtcttgaactcctgacctcaagtaatctgcctgccttggcctcccaaagtgctgggattacaggcatgagccatcccactcggccagatcttttgtttttaattgaaaacttataatacatttcagagataaaggagagctatttcagaactggtgcttattggtaagttttaaagagttaaagtcagtgaactggtggtataagccatttaatcattatgtttatcattttatagatactaatcggagtaatgcagtttcaacaaaagtagtttattttggggtatacaagaatttttattctttaagctaattaattctaaatttaaaagaaggaaaacacctgagaagcttgcgctcttagtgttactacacagaagtctcaatgtagctgcaacatctgattttaaaattttcttttttcgtcttatacttggaatatttcacaataaagtaaaaagaaaatgatatacatccatgtacctgctacttagtgttatctttttgggggacgaggcaagcaaataaaaattagagatgaagtcgaggctcccctgggtattttcccccgatcctgttctcttctgcccctttccagaagtaaacatcatagtaaacttggtgtttgttgctcctatgcatgtttttatactttggctatatgttatgtatcttcaaacattatggaaatttttgcagatttttaaacttcctaacatttgaattcatgttctatattcagcaatgtgtttattaacaaaatatcaataaaaattactaattataactgttactattaataatgaatattaataaaatattatgaatatgatatgaggtagggattgagttttattctttcatgtggagaatcagtcgtctagccccattcactgtgcagtctgtcttttccctactgatgggtagcactatccttgtcatacataatgtttccattatttgtaggtttgtttctgagctttctaatcttttcccttggtttgactatttctgtaccgacaccaaactgttcagattactttagcttcataagcaaagtaaatctccttaccttgtttttcttcttcaaaattttcatcgctattcttagctttttctttttccatatgaattttgggatcagcttgtcaggttcccttaaaagttttatttttttttaacattgtaattgcattgaatatttagtttagtttggagaaaataggcatatttatgatattgtcttcctatacatgaacgtggtttttccttagaaattccagatattcccttatggtcttcaatagtaatttataattgtatccaaaagtcttaaaacttttttggctaagcttatttctaggtactttatgattttctctgcttttagaatggttggtcagtctctttctttccctctcctcctccctcacttattcttttccttcctgtttcttccttcccatcccccattccaacctcctttcattttttttttctctctccttccctcccttatcaccttttaattttatattgttttggctgacagttctatttaaggtagtgtgttatagagaaaagtatatggaacttagagtcaaaattgctggaaatgagtccccgcttcgtccttcaagaattatatgataattaagtcaacttttctgagcctaattctcttaatctgtaaaaggagaatatttacttttatactgtctacctcacagaatcaagtgagatatgtgcatgaggttttttcctaattaaaaattcagtgctaaaaagagttctttctaggggaaaaaaatgccaatttcccccaactaaaagtatagacatttattaaaactgtatctttagggctgggtgcggtggctcatgcctgtaatcccagcaatatgggaggccgaggcgggcggatcacctgaggttgggagtttgagaccagcctgaccaacatggagaaaccctgtctctcctaaaaatacagaattagctgggtgtgctggcgcatgcctgtaatcccagctactcgggaggctgaggcaggagaattgcttgagcccgggaggtggaggttgctgtgagctgagatcgtgccactgcactccagcctggtaacaagagcgaacctccgtctcaaaaaacaaaaaactgtctttaaagaagaataccttaatacataaacttattattttgactcttaaagattataacccttataccccacttcctaaaaaaggatgtgaaatggtttaaagggcacgtaaacatacactcacctcagttaaagatgttaaaaatagaaaatcaagttattacagtgagatcagtgcaaatatgataattatgagggctaatacagccattgtaattaagcctctctgctttcaggattctgtgggaataaggtaaatatgatttggttctattgttggatgtatttcctcctttgagacaaacctaattttactcccattaaattaaaaaaatactgtccaccaaggtttcaagacaatattgggaacaatatctgctacaacagtttcataagtgaaagagcactttttcaaatggttttttgaatgaccgttactaaaaatctgaggggaaaacagaaagcagcactcaccaaaactgatttctttggaaaaactaaaccaaggttatttagatagcttatgatctaatttgtcaggcactgagctggtttataacctagagcagtgatgctttcaacatttttgtgttaacacatatgaacttttgaatactaaaatttttggtaatatgttgaaacttccaagggaacattagataaagtaatagtaactataaggtaaccactagtacagtaaaaatgccttctagttacaaatgaatccaaagcaatctctattttacttaacactattaagcactgcagtctgagtttgattagaactgtttactctctgatctcctctgatcttttttttttaattcaggaaccaaaatatttatatgttctaatatagatataccatctttaacattggcttgaaattatgtaatgcctctggattgtagttatttgtgcttcactataccctgtcatatactggcccagtacaaagttctttctgacaagcctttctaccagtgtgttattaactagtttgctttgtataatgcagttctgctctcaaatacatctaggcaagtaaccaaaggaatcctaggttaactttctgcatttgaaagatgtatttatggaagactgaagcttattttttatatggtaaggcaggtgctcagtttttatggggctttttttccctataatttttcaactttttgtaaaaagcagacaggatttatgataagataggcctgagttcagatccaggctctaccatttgttagctgaacaaccttggaaaagttatatagcttctctaccttagcttttgtctctttatccccaatatctcttatcatgtctacttcataggacttcagatgtgaagtttttaaaaattatcaaactgtaacttattgataattttctgcttaaggtcactctaactgaggaacctacccctagaattaaaaataaatgcacaaaataagctattaataataaatgttgaaaaaagctattccgtattaccagtataatctaaactgaaacaagattttttcttagaagtaattttttctaagtataacaatgctttaaaataaccattatataaaatttctgacatagataaaaattagaatagcttaatgaaccttcactgacctgttaccagctttagtaataaaatacagtttagattaatccttttcaaccatataagatataaagtgacaaggcccctcccctctcccagttgtttaatatgatttacctgaggtagccaccattaacttcctttacacaaatgaaatcaccccataggtgctgttttgtagcttgacattttcatttaacaatatactttttaaaatatgttttatttccatgtgagtacctatgttctgtggctatacaacattctgttctctacaatgttctatataatattatggcagcaaaacacaaaagagtgaaatgagggatgtttgttttatccactgctgtgttcccaacacctagaacagtgcctgcacataatagatgctcaatacatatttggtgaatgaattaacatctagttaggaaatgtatttctaacttggaaatgtatttctattattggtacgatattctattatataattgtataatgatttatttaactagtagaataatgatggatggtaggactttgggtttttttcacctttctatgtttttttcccccttctatgtttttttcccccatattctcttcagggagcaactattatcttgataatggtggcaatttaagaaactactttgagaaaataattaaaatatgaaaaatggattttttgtttttgtttttgagacggagtttcgctcttgttgcctgggctggagtgcaatggcgcgatctcggctcaccacaacctctgcctccaggtttcaagtgattcccctgcctcagcttcctgagtagctgggattacaggcatgcaccaccacgcccggctaattttgtatttttagtagagacaaggtttctccgtgttagtcaggttgggctcgaactcccgacctcaggtgatccgcccgccttggcctgccaaagtgctgggattacaggcgtgagccaccgcacccggccaaaaaatgtatttttatggacacccatagctaaatgtctttccatctagtggctggttaaccaagcatggttcctcctgtttcctttccctatgatcatttcagagtataaccattgtttagtgtaggagagatgttatgacttttagatatgctttttttcataaaaaggaattgcctagttagaattttttaaagatatctcacagttcagcagttttgacattgctggggaaattttatccagggatacagaagaaacgttcattcatttttatttaagcacctataaaaagtaggggggtacttctggcaatacagttgggttactgtttgtggctaaatatgtgtgtgaacattacgacatttgatgaaaacagcttcattgagctactgagctctccagctgatttttcttcttggccttaaaggtttacaaggctaagaatcaatctcctctggggtagatggccttacggattttaaatatgtgttgtgataaaagtgattttactctaatacagcatagtacaagttaacttccagtatgcagaattgacctcgtgaattttagtttaatgatctcagttctcatgaacttgcaaacatagaaaaaaaataaatatttttaaaaaacttttctttttaaattgtgaaaaacgtatatgatggttacagcaaagattatgcttttatgactaattcattacattgagtcatacatattaatgattcaaattactaacatagctctattaaattaaatctaccatacagtatacaggtattctgtactttgaaatttcataaatttttggatatcaactctcagaagggtatactagtaatttgcttttacccacaaaatcttcagatttgtcaacaaaatgaacgagattggtattttcactttagtttctcagtgaaaataaagaatgggtagatgaatggtccaaagagctaagagagaagacttaatttaaactcaaataaacatgcccagaatgaccctctctttttctgcccttcctcctgccacagttagccactgtatgtctcaggttttaggcaaagtgagtcttcttatcatggaaactgtgaacattcattaacaactggttttactttgaaacttaaacagcaaacaccaaagagtgaattgttggtataatccatgggagtcttgagattgacgtcagaacaccagtacagctgtataagcattgggaagtatttttaacatccgtgttagatcatctttttgacctttccttttatgttttctctttttccattaaatggttaaaaaaaagagctttacaatattttctaccaacactgtaatgatattcttaaaaaaagcacccgtacaattattttctttgttcctttcccctttgcaactttcctttacctgtagtgttccaagttctgatggggtggcctttttttttttttttaaataaaaagtttgtttttgagaacagggctagatttgccgaaaatgagaagctagaaaataacatataccccataggcatgctcagagtcccctattattaacatattacatttgtgtggtacatttgttactgaaccagtgttaacattaatattaattaaagtctgtagtttattcagatttccttagtttttacctattgttctttttctttcctcagaaaccacattatatttagtttgtcatgttccttagcctcctcttggctgtgacagtttctcagatttttcttgttcttgatggttttgacagttcaaatgagtactggtcaggtttcttgtaggatgcccctatattagaatttgcttgatgtttttcttacgatttgactggagtatgggttgttggaaggaagatcacagaggtaaagtgacatcttcatcaactcatgccaagggtacttaccgctaacatgatatgtgactattgatgatgaccttgatcaccaaaataatgtttatcagatttctccagtgtaaagtattggaatgttctggtaggcatatcctagttaggttaattgctctggtaattgcttgggctttagttattaaataaatcatcatattggtatactgctcattgaaatgttaaatttttttttttacaaataatgtgttcagagttgagaattagattttttaaatgttcagattgtattttcaaattgtatttttgaaataaagctttcctttcctgtcgaattctaaagattttgtttatctaagggaacaacttaggttcgtattttaagtaggaagttagagagcctggtcagtttatctgcaatttaaattctagacactgagacttatttccttcattttatcttttaaaaaatagactgagatataatttacatataaaattcaccattatattattgttaatttttatgggcataagtatttatatttatggattacatgcaatattttgagacagggatacaatgcatgataatcacactaaggtaaatggggtatctattacctcaagcatttattctttctttatgttacaaacattccaattatactcttctagttatttttaaatgtacaataaattatggttgactgtaatcactctgttatatcaaatactagatcttattctatcgaactatatttttgtatcctttaacaatcccaacttccccaaccccccactacccttcccagcctctggtaaacatctttctatctccgtgagttcagatgttttaatttttagctcccacaaatgaatgagagcatgtgaagtttgtctttcggtgtctggcctatttcacttaacataatgaccttcagttctatttatattgtggcaagtgacgggatctcattgttttatatagctgaataatactccattgtgtatatgtaccgcattttctttatccatttgtctgttgatagacacttaggttgtttccaaatcttggctattgtgaatagtgcatcaataaagataggagtgcaggcctctttgatatactgacttccttaagttcactcattttaagtgtgtacttcgatgagctttgacaagtgtgtatactttttaaccaccacaaccagcatagttaagatatataacatttccatcaccccaaaaaattgtctctgctttctgtcacaatagttttgccttttctacttcatgtaaatgaaatcatgtacagtatgtaatctttctgtgtctgtcttctctgtctctttttttttttaaagacagtctctgtttcccaggctggctggagtacagtggcgcaaacacagttcacttcaggcttaatatcctgggctcaagtgatcctcccacctcatgctcccaagtagctgagaccacacaggtgcacagcaccacacctagctaattttttagtattttgtagagatggggtctttctgtgttgcccaggctggcctcaaactcctgggctcaagtgccctgacccctgcgaagtgctgggattacaggcatgagccactatgcccagcctttcttctctttttttaggcttaatacttttcagatgcatccaaattgtttcatataatggtagtttgttcctttttcttaccataatagtattacattgtgtgaataagtcagtttctttatccattgacctgttggtggaggtttggattgtttccagtttttggctattttgaataaatctgaacattttcctgtaagtttttgtgtggcatatatttttctttctctttggtaaacatctcagagtagaattgctgagtcatatggtaaatatatattaacttttaaaaaattcttttatttatttttttagagatggggtctcactatgttgtccaggctggtcttggatcagccttggttagggatcctcccacctcaccctcccaaagtgctgggattacaggcatgagccaccacacctggccttgattaactttataagaaactgccaaattgttttccaaagtgcctctgtcattttacattcccactagaaatgtcgaagagttttacttgttctacatcctcatcaacacttggtagtatcagtctttttaattttagtcattgtagtgggtgtgaatggcatctcactctactttttatttgcatttctctaatgatgaatgatattgaggacttttcatttgcttattgaccttttgttctcttttgtgaagtgtctgttcaagtcttttaagaagttggcttgtctttgtcttattgagaggtaaggtatgggtcctttgtcagttacatttagaaaatgtttttctttctgtttgtggcttgtccttttatttccttaacaatgtctttcaaagagcataagttattaattttgatgaagttcagtctatcaactttttattttgtattcatgcttcttggtccctatcgtaaatatcttgacttaacccaaggttgcagaaaatgtcctcttaattttttctagaagttgtatagtttagctcttatgtttaggcctatgattcatatcaagttaacatttgtatatggtgtgaggtaaggattaaagtttgtgcgtgttttggcatgttttccagcaccatttgcagaaaagactgtccttttcccgttgaactgctttggcatctgtgttaaaaacttaatagactgtctgtgcatagttgtatttatggtttctttattatgttctgttgatcaatatgcctgaacatattgattgatttattaccttagctttaagtctttaaataaggtaatataagtcttccaattttgttgttttcctaaaaattgttttggctcttctagatctttgcatttccatatgaatgttagagtcagcatgtcaatttctatttacagaaaacaggctgagattttgtggttgtgttgaatctggatcagaatgtggagaattgacatcttaaattaggtctcccaatccattggcataatctttctctccattaatttagtagtcttctttaatttctctataaacattacatagttttcagcatacagggtttgcacatggtttgttaagtttatgtgttttgaggttataaatagcatttaaaattaatttttaattctttattaataatatatagaaatacaattgatttttctatgttcatcttacatactgttactaaacttgctttttggtgctttttttatatagatctctggagttttccataatgtcatgttattaaaaagttttactttcatttaaaagatgtaagccttttatatatttattttcactgtcttactcatttggctgaaatgttaaaagaagtggtgaaagcagacatgtagacatcttttcattgttctcaatcttatggaaagcattcagtattttaccattaagtacgattttttttttttccatactctatcagtttggggaagttaccttctattcctagcttgtaagaaattttataattaacagatattgaatttagtcatatgctgtttctgtatctgtttagatgatcatatggcttttctgttttctttcttttttttgacttgccaggaggtattttcatctgaggcttttctttcttagactggtgatacagtgaattacattgatttttgagtgttaaacctacctggcattcttaggataaaccccatttggtttatcctaatggtctctttattatgtattatgtattattctttttatttattgatagatttggtttactaatattttgatgattgttcttgttcctttgttcctaagggatatttgtgtttagttttcttgtaatgtcattgccttgttttgatactgagacagtgttggcctcagaaaattttttgggaagtgtcatgtgttttcactttcatttgtcagatgtagaattgttatctcttcctttaaatgcttgtgataattcaccagtgaagtgagttttctttgtggaaatgttttcaaccagcaattaaattcactgccccctgagagtacccactattctgacttctagtaccatagactaatccttaaactttttttggattaattttttatttagagaaaagttgcataaataacacagaaaattcacgtagagttcccatataccctacacctagttttcctgattgctgacatcttacattattgtggtatatctgtgaaaactaagaaaccaaccttagtacatactgttaactaaacttcatacttcatttggatttttccagctttttcattaatggcctctttctgttctaggatcaaatttaggataccacattgcctgtagttttcatgtttccccagtctcttggtttgtgacagtttctcagtttttccttgtttgtcacgaccttgccatccccgaggactttgtagaatgccccccagtctgcgtttgctgctgttgctcggtattagactgggttatgcgtttttggaaagaatcctcttttcctctcatcaggggtgcatgatgtccacgtggcatcactggtgatgttaaccatgaccacttggttaagatagtgtttgctaggtttcttcactatactctgttttttgggaacacattactaagtccaacccacactttaggaagggggagatatctacatacatggtttgaaattcttctgtaaggaagatttggatctttccccacatttatctgtttattcagtcatttatatcagtatggactcatgtatgtttattttatactttgagttctaatgctaggtttcttttcttttgcttaaattgttccaactttggctattgggaaggttttccggttactgtttatgtccctttcatatgcccctatccttttgttttttgaacatctcctgacgtggtactagaagatgctccaggctcatcttgtattttctttgcatcagctgtagaatcagccatttgaaggaactagcattccttttatttaggaaccaaaatgtagttactaggtgtgctcattgctattggagtatcgttgcttttaggccctctcaggggacagagctaggtaatatctgtgtgaatactaacccatgtatacacatacatctctaattgtttctatatgtatcagttggcatatatgttaagttaaacatgagttgatattgatgtctctgattataatccattaccacaaggttcactctagtcctcctttttaatctgtgacttccttgtctgaccataagaaacctggctccagccaccccattatccatccacttattttttcaacctatgtacacatgaaaagcaaatttagaattattaccccataccccatgagtacagtatttatgtacagtttcttttgtcattagccttacaatttcaagtcaaaacaccgtgttccaaagtttgttaggtaagctcctttttcaccgccccttcagtgaagttatgtcatacatttgtaatgcagttagtttcatttgtcgcaatccacatttcatcttgggatcctctgacgttttggttgatgttagtggttgttgtttggttaacatttgttgaagttcactctttgtactgtgccattctgtgggttcagacaaatgcaacgggtcatgtattcaccaccctaatgtacagcgcagatcctgcaccctaaatgtccccctgtgcatcccgtttgtagtcaaacactctcctctcctctagtccctagcaactactaatttattttctgtgtctctacttttgcattttccagagtgttgtataaatggaatgatacagtctttggatttttccatgtagtaaaatacatgaaaaatccaaagattgtatcgggcttctttcatgtagtaaaatgtatttaagattcatccatgttgtgtaaattaatagttcatttgttttaaaaattgttgtactattccattgtgtggatgaatcataatttgttttttcattcccccattaaaggccattgtagttactttcagtttttggcattaggagtaaagctgctgtaaatgtccatggccaggtttttgcatggatataagttttcaagtcccttgtgtaaatacctaagagtatgattgtaggtcgtatggtaactctgtgtttaactttcgactgcttttgttctttatagaaatggagttgtgcagtatgtgctcctttttaatctagcatctttcttttgaattgtttatgacatttatctgtatattttgagtggtcataattcatttgcattattgattaatattctaatgtgtgaataaactacagttttaaaaatccattctactgcagatggacatttagatagctctagtttgggactgttactaacagtgctgtttaggaaccttcacagacatgtatttttgtgaacatacatatacatttctgcctagttgtggaattcgctggtacagctttagctgattgtaccaagtaattttctggagtgattgtaccaatttatagtctgatcagcggatgtagtttctaggtgcttaatgtcttcatgagtactgtatgtattcattcattctatttctctctctctctcattgtggttttaatttacatttccttaaagttgagcacctttttatatgtgcattggttatttggatattcagaaaaattaagaaaattgtaaatttcttctgggctctgaaagcattggggtttggaataaggggtggcttccattaggaaaggcagtaagggggccgggcgaggcggttcacgcctgtaatcccagcactttgggggccgaggtgggcagatcacgaggtcaggagattgagaccatcctggctaacatggtgaaaccccatttctactaaaaatacaaaaaattagccaggcgtggtggcgggcgcctgtggtcccagctgcttgggaggctgaggcaggggaatggcgcgaacccaggaggcggagcttgcagtgagcggagatcgcaccactgcactccagcctgggcgacagagccagactccgtctcaaaaaaaaaagagaaacagtgtctttgggggagagccaggtgttggtgaaggcagcgtttggagtgcattctgtgaagaagttaagagtgtagtggtgtttggtttcttgtagcaagagtcctagagcagtggtccccaacttttttggcaccagggaccggttttgttgtagacagtttttcaatgggactgggagggtgttcgggggagggcagtagtgggatggtttcagggtgattcaagcacattacatttattgtctaccttattttcattattattacattgtaatgtataatgaaataattatatactcaccataatgtagaatcagtgggaaccctgagtttgttttcttgcaacttgacggtcccatctgtgggtgatgggaaacaatgacagatcatcaagcattagattttcataaggagtgtgcaacctagatccctctcatgtgcagttcgctatagggttcctgctcctctgagcatctaatgctgccactgatctgacagaagtggggctcaggtggtaatgcgagtgatggggagcagctgtaaatacagctgaagcttcacttgctcacctcctgctgtgtggcctggttcctaacagatcatggaccagtattgtctgtggcccaggagttggagacccctgtcctagagtacacagtgaaaaagtttgatagagaggggaacagtggaagattttgttagatatgtcacatgattaatggatgactaaagttttgtttggtgatctaggatgatagagatgttgagacatgaaattagttggcttcaagttctaagctgtcctgtgtgagaaattgcctcatcagccaacacaggctttgacatatgggtagcttcgtgtttcttaggatacttgggctggtcagaaagtgccaagcatcagagaaactgagacctcggtataggtggaggaagtctaatgatagccacagtcagtagcctagtctgatttgtttttagcaaatctagactattttcttaatcagtaactacttctttagtaactacttacaaggcgactgcctttgccaaggtatatgttctctgaaagctgattcttcatagatcactaactgtagttttgaggttctgtgatttccttcaaaattcacagaaccttgagctataatttatgtggatagagtgattactgggatttaacttaaaattagatgtattcaaatgttttaaggaatatgttttgtaaaacaacatgtttttcattcgttacttatatattgatcccagaaattgtgtgcctgcaaattgtcaagttgggttgatgcttcagaaaaggaaagtagaggctgagtcttcttagtatagcaatgcattttttagagcagtgtttgaggcaaattattttcgcaaaattacatggcttctagggattagattgcatgagtttgtctcttgttcctccctcattctactgtaagaggccaggctgctagttaacagaatgccagacataatgcctagggcatagtttgagacctgggaagattcacaataatcaaacacaaacagacagagtagcatgaagaaatttcaatcctcccagtcttgcttacagatttaattaggcttattggggcagaaaatatttttcctccccccatgtttaaatctgtttctcctctactcccacctcctgtcccagattctctttgaaggggtaatactagcaacaaaaggagatttttttttttttttttgtaaatcctaacttatttggtttatctggctttaggaaaaggagcagtaacaacaaccgaattttaaggtatttgagggactccattttttggcactgtatttgggaaattcccaatttaaaaatcatgctgtactcaagaagaaaattagggtttttttgtggctttataattggatcttttttgcaagtatttttaattttatgagaggtatttggcctgttctgctagagaattatcagccaaatccttgctttctttatattatatatattttcctgagtgatattctagggaaatgtatatggatgctgttctctgtctttccattagcagcgcagtgttgggcttcgaatgatgatggtagatgattgggggtgggagaagaggtggggtttcttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtaatctactgcagtctttgttttctgggtcgtgtataaaatggagcaaaatggtagaaaaatagcttcagtgaaagggatgtacctgttaacaggaataaaatagaaaggaaaaggatatttttacattgttcattattatttctcacaacagcttttaggatttttatcatgttttaaaaaacctaatttgacctaaggaagaaaattcctagttttgaaaacccgtgccttaattgcttagctttagaacaaaggtttttacatccagcattgcaaggatatctttattcaaaagaataggatgcagcattcttatgttacctttttagaactgaattggcataacctctcttgaatcttagagactttgacgtattattctgtgaattgtgatttaattatctcatgcttcaggatggttgtttccctttgatacccaagagaccatggatgggatatagggggtggggattaatattacagtgggggaagggagtgtttttacagagtaaccttcctgtttttgcattggaaactaaattgaaatatataatcattggaaaaggtggtatccatggcaccaatcttatcaacttgaattattttatcctttgttcagtttgtggtatttttgctcttgtcagctgaaatgttgattataaatttgaagaagctgccgagttgctgtgatggcactggaattgcattctgctttctttttctttccaattatagctgtaaatacaggaaccaagggatgaatgtgaaaagaagtaatataaaatgctgaagatatttttggttttctcttgaaagtatttttcatagtgagaattattttcttgtggacagaaagagctaggaccctaatttatgacattaaaaagcatttaagtgctacagacttctctatttaggaaagacagactgaaaacatgttgaagcgtactatggagctttcagttaagttgattatttccatcatggtgatatgagttatcatactgtttgccacattttgaaagctgtttgactcctcagaagtattaacaaattaacaaattcttactgagcatttacattatgctaggttctttagatgtatatcaggtttatagtctagtaaaggatataaaaaactcatgcatatgatgtaccatttttggtgcaagcatataagtattgcagtgttatatatttatgtactgacatgtaggtgttttacataagctactacatttaatcctcataacaacctagtcacgaaattattgtcattcttgttatcctatgcacattagtccaaacaagcaaacaaaaattgtcattctcttttatagatgagaaaatttacattttgagagattaagtgatttaccataagtaacaaagccatgaagtgatgaagcctgggtcagtcagactctaaagctctttccactgtttgtatatgagtagattaaagcattttatcatgattatttgacatcacaaatagtgatgccatgagtgaaaaggagatagggatcctaatctttaatctatgccaagaactgagtgattgagcaaatcatttaacatcgtctgtaaagtgtgagggttggactaggcaaccttggttcatgattctattcagtgtaagagattttcacatatggtctatggaaacaattctcattactttagtgtttttattatatttagtttccattactcatccttcataatgtgctgtacatgttggattgtgtgtggtggggggggagggtgatagagtgcatatcatcttctaacatattacatacaatatacatttatttattaagattattactgtctgtcatcttccttcttcccttcccccaaatatgtcacgaggacctagactagagcctggctacatagtatgcagttataaactaattttttgaatgaatgaataggaataatagacttgtatagtacattggcaaaatatataagtaacttcataattcttaacaccaaaagattccctgggggccaaaattattaatctttctattacagtgatcctttaaggaactaagtgtaagaatcttaaaaagaagaacacctacgaaacaatcaagtgtagtcaagtaatctgaagtttgctggaattcccccatacaaaattattggtagtatagaacttgctaaccataggtttgtttacccagtgttctatttgaaagtagtttactaaagcattccatataagcaaagaaaaaaagcagcaaagtttcttttttgtttatgtgtcactgtatagtctcaaatgctgtaaatttacagtgagtagaaaatattcagaccattgagtcttttgcttaaaagatatttcgtaaggtataacataacgtttactggtagttttgtttcatttaaacattaggcttcttgagagttttaacagttttattgaaatgtaattggtgtataataaactgcctatggttagagtataatttgataggttttgatgtatatacacgattaggaaactatcaccacaattgagaaaataaacatattcaccccaaaggtttccttgtgcattttcataatttctccgtccctccacccctcctcacctatccccaggtgtacccattgacttgtctttggtccttatagagtagtttgaattttcttgctttctttcttgtcattatagattaatttgcatgtctttttgtaagtgaactcacatagtttgtgcttttcttatgtggtctcttttactctgcataattattttgagatttgtctgtattcctgtgtatcagtagttcatttctttttattgctgaatgatatcccattgtgtggatataccacagtttatccattcagctgttgatgggcatttgggttgtttcaagttttagactattaggaataagtttgctttggacattcatgtacaagtttttgtgtgtacataagctttcatctcttaggtaaacacccaggagtggaatggctggattatatggtaggtatatattttaactctttaagaaattgccagactgtttttccaggtgactgtattgtgttacattcccattagcaacattccagttgctgcacaacttcattaatagttggttttgtcagtctttttaattttagccattttactgtgtgtgtgatggtatcatattgtagtttttatttgcatttcatctgatgactaaaaatgtttaacatattttcatgtgcctgttttatcatccatacttcttttgtggattgtctgttcaaatcttgtttttaattgagcttttaattattgggttgtaagagttccttatatgtttgggatataagtgcttttattttttttttattttattttattttgcgacagagttttgctcttgtttcccaggctggagttcaatggtgcaatcttggctcactacagcctcctcctcctgagttcaagcgattctcctgcctcagcctcccaagtagctgggattacaggtggccaccaccatgcctggctaatttatttctagttttagttttagtagagatggagtttcatcatgttagccaggctggtttcgaactcctgacctcaagtaatctgcctgcctcagcctcccaaggtgctaggattacaggcatgagccaccatgcccggccataagtccttttaggtatatgatttagaaatactttctcccagcctgtggcttgtattttcattttttagcatcctctttctctctttaatacttttattgagatataattcacatttccttgagcaaaagttttaaagtttgaattctaatttatcattttttctttcgtagattgtgcttttgctatatctaagaaatatttgcctaacccaaggtcacacctctttgcttctagttttatagttttgggttttacttttaggtctgtgatacattttcaggtagtcttttatttttaatttttgtgggtacctagtaagtgtatgtatttatggattacatcagatattttgatataggcatgcaatgtgtaataatcacatcagggtggatggggtatctttcatctcaagcatttatcttttgtgttacaaacaatccagttgtactcttttagttatttttaatgtacagttaaactattttttactataatcaccctccactacccttcccagcctctgataatcatccttctactttctgtctccatgagttcagttgttttaatttttagcttccacaaatgagtgagaacatgtgaagtttgtctttctgttgctggcttatttcacttaccataatgacgtccatttccatccatcttgttgcaaatgacaggaactcattcttttttatggctaaatagtactccattgtgtatatgtaccacattttctttatccatttgtttgttgatagatacttaggttgcttccaaatcttggctattgtgaataatgctgcaaaaaacatgggagtgcagataacccttcgatatccaggagtgtcctaaatctaaggatgtgtcatattattttttctttatttttttctcctcctgctgttccgggtctctacagtgtcccctactcctttgttttattcgcacacctgggtagtgcctttccaatcaaaggatagttgggtctgcatttcaggtctgtgatctttatgtttagggaaatccgtttcctggtcaaagcctaccagacttccttggtatcactccagaatttaacagatttggcaagtatgttttttagttaatggtttgagatcataatcatttccttcatgctcctcctgccttctatttttgcttttaatattgaggaatgctaatggaatagatttgcttttgctctctcccatctttacctggaattgaacacatatttattgaaggaatgagtggtttgcaggaatgttgccattcaggtggagacatgtttctctttaaatatatagctggcaagttgcccatatggcacatagatattaactgaattatccactgagctctgggattaggagatacagattgtgtaggattgggagttctttctattggcttatcttttcctaaaactatgtaacgggatatgaatacctttctacctaagtatcttgtcattatactagatctagttttctgagtctcacttgtgaaagcttttggttaactattaataaaaaactgtacaaagggaagatgataatggtttctcttgtaaggtggtagtccaggggttgaaagcaagggttctagttagactgtgaggttttgaatctaagctccctcttctactagttatataacttgtatatgttacttaacttctcagaacctcacatttctcttcaataaaacaaggctaaacattttacttatagaattattgttaaaattaaatgaattaatgcataaaaagtacttaaagcagatactgtaagtatgcaagtaaagctactcaagttttagctattattgtaaccattttaattgttaattattgttcttatagataatggatgatgtgtttgaagctatcacctagcacaatttctgactaccaaatgtagtttgaggcttttgagtgtttttcacctaaccattcttcccaaatgaatatttttcagggaagctaaccccaggaaatgtgacacaatttactgtattgttccttacctctataatgtatgtttattctagctggttcatctcttccttatatacaagttccacagaatgatttttttctaataagaattaagaaacctttgttctgatgatgagcttatttaaatttgggtttaatttgatagaaaattaagctgtttccttaatggggaatctggccaatcaccatcctccaccctcccagggtagaattttttccaggaattaaatagctctatctagcagggtcttcctgcctttggcagtagagcagtacaaaggccacattgagcatagctgctggggaaaccctttttccttctctagcctataaatgctgttctgtctctgtgaaaagccctgacatcagctcttggaaaaatccaaatacttgtgttagaacaaggctgaaacacttgcctgggcagagactaatggctgaactatagttctaagtttaccagattgcctctcagtattgttatgctttaaaaaacaaaacaaaaactgtaagtttcagacataatctagagaaattaggatagaaaggacaacttaatagcgcctcccattctttgctagtttcttcttatttttctcttttttctaaaaatctaccttcaagataatgtgaaattcttgcttgaggagtgagggagagaaataatatatcaatattataaactttatgcagtgttttccacatattagatgctgcataagtatttgatgtttgagacaaaataaactgtaaacagactgtacttaacttccttagtgttcaaattagatcatgatgtaaaactctccagtggttttccattatattatgaataaactctaagcctgtttctgtggctcacattcttacattagctggcccctgtctacttctgtggatctcatttcagcactactttactactctcttggtcattttctatgcttaagccacagcggactttgtatttctcaaatacattaatctgcttatcctttgtgactcttgtactagctgtttcctttacctgtaattctgtggcccacatcttcccatggctggctccttcatttaagtctcagcttaaatgcctctaaggtcttttttgaataaactaaattaatgtatttagtcaaataatatctttttttaatagcacttaccacgatttgaaattctttggtacaattatttttttgtggagtttatcttcctcctgtggaatgtaagctgcttgagagcaaggaccttatctgttcattaacgtaacctccagtgtcttgaacctcctggcataggttggtgtttgtgtaactttgtatgtacttggctgcctgtaacggaaaacacaagtcaaactgacttaagcagtaacgcatttactggctcacataaaaaagaaatctagacgtaggcttcagagatttttgatttagggacgtaactatgtcaagggctcagatgctttccatctttacactcttgccatcaaaatcatcctcatcctaaactagtccttaaagatgaatgcgaagtagctgttaaggctgcttgcttcttcactcaggttcagtgggagggagagaaagaagtttcacatcattctctcaagaataaggaaatactttcatagatgccaccagtgaactttgtttctacttttattggcttttttggaaccaattgcttacccaagaatggaattactgttaggccaaaaaggcccatcactgttgctacagatggggttggcttgacctgagtcatctggactctgagaggaatagtagataactgaataaaatcggagttctcttaaaaggaaggctgtggtttctggggtaacttatatcctctgtagttctcaataaaaatgtatggaatgagtgaattcatgtagtaaaaatgtattgaattgtcaggcgtatgctcagcaccataatagttaagtagaatacaaaatcaaatagaatgtggtccttgccttcaaataatttaaaatctagtgagagagccaaattaacggaatattaaaattgttttaaaaatcagttgattaaaataatttaaaagatgaaaaagagaaaagggaaacaacagatgagacaaatagcaagatgatagacttaaatacattagtaatcacactaaaggtaaatggtccaaacaccccaattaaatgtatagactatcagattagatgaaacagcaaagcccaactgtatgctacaagaaacacaccttaaaattaaaaatacacattgtttaaaagtaaaaggatggaagaagatgtgccctgctaatctacattaaaggaaaactagaccacattaatatcagataaagtagatttaagattatagaatatcaacagggataaaaaaagtaatttcgtactgataaaagggtcaatttaaaaagaagacatatctaggcatgtatacacctaatgacaaaacatcaaaattcatgtaacaaaagctgacataactgaaaggacaaatagacaaatctacaaacattgtcagttatttcagtatccgtttttcagtaattgatcaaagtagataaagtaagcaaggatatagagtacttaaacaatactgttggccagtttgatttaattacatttttggaacattccagccaacaaccaaatactttttttttttttcatgtttgcaagcagacatgggacatttaccatgacagacacaattctgggctgtgaagtaaatttcaataaattaaaaggattcaagtcatacaaagtatgtttcctggtcaccatggactgaaattagaaatcaataaaagatctctggaaagtttccaaatattggaaaataacacaattcttagtcaaagtggaaataaaaaaggaaatggcaaagtattttgtattggatgaaaatgaaaacacaacatatcagaatttgttggttgccattaaagcattacataaaaacttatagcattaaacacctattagaaaagagagaaggtctaaaatcaatgacatcagcttcttttttttttttaagacagggtcttactctgttgcccaggctcaagggcagtggtttgatcactacagcctcaacctcctgggctcaggctgtccccaccttatcctcccaagtagctgggactacaggtgtgccccactaattttttttagtagagatggggtctcactgtgttgcccagactggtctcaaactcctgggttcaagcaatcctcctgcctcggcctcccaaagtactgggatttcaggtgtgagccaccgtacctgaccaatttcattttaagcaactagaaaaagaagagcaaattaaaaccaaagcaagcagaagaaaaaaaaaatagagatgaaagcaggaatcactgaagcagaaaacaggaaaacagtagcgaacattaaccccaaatctggttcttttgagaaaattaataaaattattaaacctctagccagctgatcaggatgaaaagagagaagacacacattactaatatcataaatgaaagaggtgacatcattacagattcttcagatattaaaaaaaaataggggaggctgggtgctgtggctcacgcctgtaatcccagcactttgggaagccgaggtgggcagatcacttgaggcaaggagttcaagaccagcctggccaacatggtgagaccccatctttactaaaaatacaaacatcagccggcattgtggcgcgaacctgtaatcccagctacctgggaggctgagggatgagaatcgcttgagcccaggaggtagaggttgcaatgagctgagatggtgccactacacaccatcctgcccaacagagcaagactctatctcaaaaaaaaaaaaaaaaaaaaaaaagataagggagcattatgaatagctttatggcaataaatttaacaatttagatggaatgtggttggtaattttataaattccaacaatatatatacaatatgtaaatatatattacatatacataaaacaggaaaatacataaaatatatatgcactctgtgtgtatgtatgtgtgtgtaatgaccgggtagggtttatcccaggagtgcaagattggttcaccttacaaaaatcaggcaatgtaagtaaatggatggtaaatggtggtaactatgtttctcactgtctcaaaggagctaagcaagagagaagactggaatgaacctgatggaattagattagaattagagatatcagtatgaactcatgctgagcttaatatagatacagatatatggatagctacagaaagaattatagatatgttgtattagtctcttctcacactgctaatgaagacatatccgagactgggtaatttataaaggaaagaggtttaattgactcacagttccacatggcttgggaggcctcacaatcatggcagaaggcaagtgaggagcaaagtcatgtcttacatggtagcaggcaaggagagctcgtgcaggggaactcccctttatataaccatcagatctggtgagacttattcaatatcccaagaacagcatgggaaaagacccccccccttcatgattcaattacctcccaccaggtccctcccacacatgggaattatgggagctacaattcaagatgagatttgggtggggacacagccaaaccatatcatgtgtatgtataccccagttagtataacacattcatttccctgctctctctgctgagagggcctagaaatggtgacatctcagtagcagtgagcgcacccagctcctggatcttggttactaaatatcactctccaataaaatagctccttggagaaatggttgactctaaggctgcaatagggaaaatgcaagttgaacctagagtgccttatagtgccacaaacaagaaagtgcccaaacagaagggtgagagcatgtcagtggcataaacgggaagaatttgagcaagagaataaataacgtagtattggattagaactcaaagtctaaaataaacatacatgagcccatactgataaaaatgattacataaatacatgggtgagaaaacacaaatcttccttacaggaaaatttcaaatagtatacgtagattcctattcccaggagatggagcttaatcctctcagatgctagtgtggattgggcttagtgacttcttcaaagaaaaaaatatggcaagggaaaaataataactttacagggagacgtcgagcaaccactcccttaaccaaatgaccaaagttaacattactagtgttaagtcatattggtgtcatatatcctctgatgggtgatgaaaagggtacttcacccctgtggtattccaaaaatagacccacgtatatatggaaaactgattttcaaaagtgcaaaaggcaattcagtttcaacaaacggtgctggaacaattggatttcaattggatatcacactctatataaaaattattacaaaatatattgtagacctaaaagtaaaatagaaagtcactcagctcttagaagaaaatgtaggggtaaatctttgtgatttggggttaggcaaagatttcttaggtatgataccataaacatgggcagtgacctaatttccaaataaagtcccacaggtatggaagttaagacttcagcatgtctttggagataacacaattcaacctgcaacaaatataatggttcccaattaggactgctttcatgtttaatacagagaaactgagaatctctatatgagtttagtgcttttcacatactacctaagaaatgcatcttccacatttacatttagtcttccaatgtgttggtgttgtcattaacaaaatacaaattctcctaaaaatattatgaattgtagctttgggcatttattcagtttgtggatagtataataattgctattatgtgtatccctgggttttgtttgtgtgtttgttttctactttcaacacaaatagggagagagtctctctcaccgatttcgtgccacactttgtcacttgggcattaaaataattttaccctggccctttgtcttacaaggtctgttgccaaaacaagcttcttcagcttctgctgctgtttccataaagatttgacatgagttcatggaattgatctcggggacgagtgtgtcctctcttttctgtttacctagtacccacagaaactcctgtcatttctagtccaaactcccacctggattccttactataaatgaattcatcccaaggaagaaatcaagggggagtatagaacttgggttacaaggatatttgttataacattctttattatgctgaaaaattagacccagcctaaatatttacaaaagggaacttcttaattaaatagccatatcacaggatactttgcagttatcaagaattatttagaactatgttttttaaatctttatctgatttggaagttcaatatatagaatgaataaaaaacaaagcagctctgatatgtgggaagtctagagccccatctacacactcccgctctgtgagggacctcttttaaacctctagaattttatagagcacagtttaaaaccagcactgtagtgaaatatttaatatgtaaacatatgttgatattttatgaagttaaagttgtcaatatgtccagtatgctttaatttttatgaaaataaattttaaacattgtatacagaaatctatctctattttgggaaagaatgggaatatatgcataacaatgctgggtgttgggattatgggtgatttttgtttactattttgtctttagtttttaaaagtttatacgtgtacttctttggacataaagaaagtgagacatttcttcatattgaaaaggcagagagaaccattgctttataggaaactacagtttggaaaaacggcagtctcattactcaatcccttgagagaggaattatcttgaaaatgttataaaaaatattagtaacagatttactagtgtcagtggtcttgtgtgttaagtatattaggataagccacatttgtaacagctaacggagaaaacataactgaatgtcagtgttacacagtgaactttgtagagcagtgattcccaattctgagatgttgtaagaggaatgtcagaattcctaaaacactcatcctccaacctttcaaattcagtgctgtggtgagccattgttactgataagggtatatcccacttgtgatttctttgttttgggtcaagaaaagcttttgtagaagccagtgtaaaatggcatgcatataattaatttcctcatcttttcctcataaaatcagaggtccttttatcgatggtggtttgaaagtctggggtattcagatttggcagcagaaagtgtgttttttttgtgtgtgtgtgataaactaggtggattgctaattctgattgaggaattcgtaatgtttgacaccagaaccagagcacttgtgaaaagaagtctctttagtacaaaaccaaaaatttaattacagcatttgttataactatagccaataaaagtatttttaatgaaaaagaatttccgcagaagaaaatgctttctattaatgcagaaggtgttatatagaagatttaattgtaatgatattggttatgatccgttttttgttttatctttacctgtattttatattcgtataacctctaaattttacaaattacccataatacatttcttatataattaaaaaaattctgagtacagaacaggaaatatgttcaatctttattccattagagttctacttggaaagtattaatatgtaaggtttttatttctccataagaaatagacctatatagtcaggcacagtgtctcatgcctgtaatcccagtgctttgggaggctgaggcttgaggattgcttgaggccaggagtttgagaccaacctgggcaacacagcaagacctggtctctacaaaaaaattcttaaaaaatttagctgggtgtggtggcatgctcctgtggtcctacctacttaggaggctaaggtaggaggattcccttgagcccaggagttcgaggttacagtgacctatgattgtgccactgcactccagcctgagtgagagagtgagacattgtctccaaaaaaaaaaaaaaaaaaaaaaaaaaaaaagaaaagaaagataaatagatctatgtctagttaattcgaggagatggtacacatttttagagcacatgagaacgaagtttatacttttctgattttctgggtttccttgatgattttttggcaaatccttgtctgtttagctgtctggcatatgtatgactgtggttgggcttctttgtactcaaccaatgaatgcataccaactgtaacacctgaaggtaggatcatgaataaatactctgtgatttggggttagtatagttttggttgttttcccttctcctgagatttcagaaataaaagattcctattcctgtgatttttttggcacacagtaagacatatttgatacataagataagtcattataattaacttgtcgaatcactttttcttgctgcagaatgatatttttatgaatgccttaggttttttcaataaaaaatgcaaccaaactgcaaatgtactgtgatttaaagtggtaatgtcagaatttaaattttgagtagtactctttttttaaatcatagaatgctctatgtttattcaaaaaagtaaaatattattagacagtattttttattttaattttgcatttaaataaagttctcaagctcagactgaaaagtaaacactgtatgttggagcctgtctcaacgacacttaaaagctaagactttctactttttcagaagtacatttgtatcttttggcaaatgtgtagaaagcagcctgtcctaacaaattttgttcacctgttctcacttcagtttatagattgttaaacatttaatcataatatattttatatacaatatttatgtgaaaaatgcccatccttgattaaggggatttttttctactcttatttttattatttttaccagtatattctgaagtagagaaatgtgaaatgagatgaagatttaaattcctagcaaacagaatcatgcattgcccctgttttataagtaatgagatcattttgtagagtccagtttatttacatttgttaaatgatattaatatctcttccataagcatgaatttggtggtttgcatggtgttcactgaggtgaggatacttgtttaagtattttgaggatctcatactttcctagcagttctttttacttggttttctgaagtgaatatagtctttaaaaaaaagtataaggtactagtaatcagatactcatgatcacaaatgaaagtggtggagaaaccttttaaggaatattcacaaaagtgataattttccagattgtcaatgaggaaatgaaagtctctaataagctgtcacattaattgtgagctgcatttctcagtcagcaacaactaatagtcaatctataatagctccagcagagggaatgaaagtaatttagaaaaaagtttactatttgatttgtcaaagtgtgtccaggaagtaagagagcctaaccaaggggctgttgtgcatgtaagctcttcagtaaaagtggtggtgtactaagctatatttaagaaggtaatttgagattttatattacatgctagtgaatcatttttggattttgcaccagaactgagctctttggtccctgcctgtctgtggtttgtgttgcaaggtccagaggcttaaaacaaagaacaccatgggaaattctccatgagtcattccgtcagctgtagcttctgttttatagtccttcggatataactagtgttttaatgccagctctcctagccgcttttcatgctttggttctatatgctaataaaaaagtatggcagtatggctattgtagataacgttcagacttttttttctcccgattccacaatttttagttcttctaatggctctaagctagaccaattataaattgtaactggtgaaaagatttatgactgtttattttgttgtagttgcgaggtaagcgagtggtcacttaatacttttggttctgtgaatcttactgtccagagaactaaagattgaattagcagttcagctggagtcagcactatgtgctaaatccctatacttaagagctcttatgtattgcagacaaatgtcctcttagctgttttgttattttgtgaaaaataataataatagagcaaggcagtttagattcatatcagtttcaaattttaagtaccatgttttaagccattctaattgttttgtagaaacagataaattaaaaacttgatttaaatccagcccacaggatgccttaatcacctttgatattttaaaggagatgaggaaataatggacttttttgctagtaagtggcaggtatggtcaacacaatttcactacatttgaaaaaaatcactttccctgcttgccaggaaaatttaaagtgcagattgtaacctgatcttttttcttacagtgtaacgtctgagaagttcaagtattgacatgaattttctatgataccacttggtaaattaaatctgtggtttcatcactggctttgaattatatatttctatgcattttacttagctaaaaacttatttgaatatttagtctttaaatttattttttcttttctgcttatttgaatacatatcaccaacattcagattttatttttgtttttcttaatagtaaatacataagtggttactgcttgctaggcaatgcttcttattttctaatttaatccccaaaacaaatttgtgaggtataggtagatgtattagtaattatgttttagaggagatgcttaaagaggttaagcaacttgttcaagttcaaatacctgttaaattatgaaactagaatattaacccagttacatttgtttctgaggagtcttttgcccccaaggccttgaaattttagggaattttcatttatagcaatcaataatactattcccatcccaccctgtccatttctgattttcaatagtatagtttctgcactgatatttacatcgtcttacgatggttgagccttaaaattacctgcattgttgtctgatttgcaattctttgtctagtaactcttctcactggagtgggttccaataaaatggtgctgtatttcactcaaaatcaagttgcagtgttttttcctcctcattttaacatcactaaaatcagagtgtatctactaatggaattcttgataattctaaatttaataggtaacattctttgactgctaataaaatcttaaccactatccaatgtaagaaaaatttgtttaaccatctccccttcatttcaaccattccttattaagaagaaccaactacagtctcaaatgctcctttataactaagcccagggaagacatatctaacaccctagaggagagagaaaagggtatgaattaaggtttgagtgtgatatcagcatttcttctcatatggcttcagaacacttctcactgaagtattgtcaaaaggctctttatgcactgaaatcaataaaagaaaaaaacaatttctagcaggctatttattataagcaaatatgtgacgacacaaaactttctggtcctttgcaattttttaagtccaaaagaaattctgtttaacaatattaaaggactattccagttacaaaattgtgtgtttgtgtatgcttattagaataattaaacttggttaaaatgtaagtcttactctagtatacattatttattgggtaagtgttatttaactaccaaatcacatttccctctacactgtaataacacatcgggaagggccacctagggctttaaaattagaactcagaatttaacaaggaaaaggtattctgagttgagtgaataaatgtattctgaacgtttaaggcctttggttaagatttctaaaatgtagctgtgcttaatatacaaaatcaaaagtaaaggcaggccaggcgcggcggctcacacctgtaatcccagcactttgggaggccaaggcaggctgatcacttgaggtcgggagttcaagatcagcctggccaacatggcgaaaccccgtctctactaaaaatacaaaaattagctgggcatggtggcacgcagctgtaaccccagctactcgggaggctgaggcaggagaagtgtttgaacccgggaggtggaggttacagtgagctgagatttcaccactgcactccagcctgggtgacaaagcgagacttaatcgaaaaaagaaaaggaaaaaaaaaaaaggcatctagccaccatatcccagtgattcaaattcctgataattctttgctttattaatcatcgttcttcattttggaatttgacttttttgctatctgttaatagaaaaatacacacacacacatataagtaaacacagtatattcattgttgaccaagtgtccaagttatcaatatgatattttcaaaaaccaggcacagtttcattaggcacctgtaacattatgtcatagtcacatacagctgttctacataatatcgatccaaaagatattgtcatgatttcatgattagactacacagtggacagggacttaaaaatataggagttttgttcaccagaatgtatttcatcagactaatggttgaactgatttgttgcttatgacctggccactttgtagctttcagacctgcctttctgtagcagttgatagtatggattatctgatcttccttcccttctgggacaggcttttctcttttctaattcattttcttaatctcctacctccattctcaatcatgcagatgctagtttctcccccatatttgagcctgagcattttttcaagtttccttggtgttttacatttcagtgaccatcagtaggttgataactcaaatctgcaactttagccccaggctttctttgaggttctagctttctatttccagctctctgattacatctgtctcaatattcagcatgtggtagggattttgcaaaactatgggattatcttggtgactttcctagctgaagcagagagaactaatgaaatagccaagaaggttcttgacattgttacttatgcatataagcatatatatacacacatatgtacacatatatttatttgctttagcagatactttaaagtagaattcaatgattagagaaaaaattatgattttaatattatttgagacgttcttaatctatacttgaagtagtaagtagattatgataagcaagttggactgtgggcgtggtccttgttcattttctcattccgtttttgtccccatttttcctctcctttttcattaccttgtaagagaaaatagctcaggaaacgggtttacaatcagtagtctgggaacttccgggattctttaccagcatccccctggatgttgcagtccctgacgcaagcagcattgttttagggtaggagtttttataatggctgtgaggtcgagtgcctaaggttgataaatggcagttgttatcctttgcagaaactcagttggaatcctttctgtcaacttgtatgttcatctgtaaattaagaaacatgttcccattccctccctctcctacctcaacagttatggacagactgcttaggaactcctatttctgaagatttcgtggtcttttgtaaagtcagtttgttctctagagcagtgtcatcttgtcccagaaccccctttacttactaccactacttctttgtaagttaacatgctatcactgattaggaaaggttttagattcttagtctttttctatggatcaattttggtttaaataggtgtcgaagggaattgtaagtcagcttgtattttggaggttttgtttctacctccatgccaaatgaaatgtagtcattgaagtatcattgtattatgtttatttctgtctttactaataggcttttttaaaaccctagttttactgatgttcttaataaagtacggttcctattactaaataatctttacataaaatgccataggttgaaataatttaaaagacagaaatcaaaatgtaggatgatatttgagaagacttagattagcatttatatatagcatcaaacgcttatcaagaagcttccggcagtattcatttaaaagagagagaaccaggaggaaatgctgtagttctttcagcttataggacccccccagaaaaacaaaacaggaaagtgccctttgttttctacttttggaaggtattttttgtaaccgataattactttaatgttaatttttttctagataatctgttattaaatctaaacctaataattgaggatcacgatgacatagatcaatagtgcagtaatcaacacccagatattttgggaagtagtgtgaagtgatgggaaggaaggaactttcccttctaggaaaacagtgagaataatattttaatggcaaaatatttctttttgtcttgatttttaaaaatctataaaatggaaagtatatctcttcatagagatttctttttttcaagattaaacgagataatacatgtggaaataatgcatagcatttggtaagccctttataaatttagcaattgctcttattattgggatttttaaaaagaaaagctatattctaggacagctgatggtaaatgcactggcagtttaagatttaacaaagtagttaagatacttaaacatggtgttcaacttcttattcctccagcttattgattcttgctattggaaagttaccataagatttaaatctcttattctggttcagtaggatgaataaatttagtaacaaaatcttacaagtaaagtaactacatctatccttattttttctttgtttcaggtttcccctcaaaaaacctataaggtaagtttgctcaattacacttcatactcaagtttaggttatattttaattataagcatccctttgaaattatggtggatttttgtggtttttgagaatgtgtattcaagtaattcaaaatttcaaaatgttttacaaatttaaaatgtaaaagatgttactttttctggaagacagcattgttttgataatacttctaatataagcatttaaaaattttgttcaaaaggatatttaaggtcacactgaagagacttaattttgaagtctatttgtgactgttttgaattatgagtagcttaggaggtgaaaatagaatgctagtttttgatgtgttttatcacttgtgtgactataattgcctttagttaatgtactttggtactagtttagtcttaattactttattttttattttattttattttattttttgagatgggatctcactctgttgcccagcctggagtgcagtggcgcgatctcagctcactgcaagcaccgcctcccgggttcacaccattctcctgcctcagcctcccgagtagctgggactacaggcgcccgccaccacgcctggctaattttttgtatttttagtagagacggagtttcactgtgttagccaggatggtctggatctcctgacctcgtgattcgcccgcctcaggctccgaaagtgctgggattacaggcgtaagccactgcacccagcctagtcttaattactttaagacagtgaagaaaaaaatccaaaatgttaaaatgtatctatgcctatatccatgtctatatatttattcatttccaggtcttaaatgcctcttcctcagtatttttgctttcagcatttcttctgttatcttatcataaatattatttaaaatgtaggtagtatgtcattcctaattattatattttatcatttttagtgtcagcatagtccaggatccaatgctaaccttggcatttcagtgaatatgtgtatgtgtacatatgtattattgttatggtcttgtcacccaaccattatctgatcagtgtaattggctaagccatagaagtaataataataataatgtcattggtccttaaagtggttggctaagacttctgtggctagaactacatcagcaggcttaaaatgaggcttgcctaaggctgctttttaaatgttaaaccgttctcatgcatgctctatttatgcagtgattttgaacttgatcatagtatatgtagagttggagaatgggtttaattccttttaggcactgtgttttttttgtctgttaaatggaaatgatagtattgacctgtgaaaaccacacaaaaaaaatgtaagcagttacttctgagaataaaagagactttaatgctgaatactatttttaattattttaagcagtttttataatcaagtaaatagactgtgtataaccaaaacttattgaaaaatgtaaattagagaggcttatggtgctgtgtaaagtaaactgatttcctggtttttcttgtaagatccacttttagaattttaaattttttattctaatgattttcttgcactaagcatttgattactttgctttaatttaggcatggaagtattttgaaccgagagtcaccaacagataagaagcagaaagttgagcgcattgcatcacatgattttgaccccacaggtaaaacactattcattctttcaaagagtattgagagtagtgaagttcagaataatagagcttaagctacccgaaacactcaggaatagttgtttgatctgttttaggactctcacattcctccaattatatcataataaagcctttgcatttagtaggaatgcaagcatttttaacttccaacactgtacattccactacagaagtatcattgtagagtatattgtatctttaaatagtgataataatagaaatggttatataataattggagatttggtcagatcaagaactcagtgttaagttgaatcatggtataagcagtaatatgtcataaaaccaaggctctaacaactcgacacttgcgtagtcatctaaaaattcaattgtgattatggtgaattggagttttagataaatcagtttcacaaattaatgatggtctcattttagagtaaacaaatgaatagaaatccctttctcttcagtcaaaaagtattctgaacttaaagagctgtctttcaacctaagcagtgtcgatctttcctagggttgtcaccttaacagactttcagattgatctccttttaaaacatctaggctttttccttttgctttctccttgtaagcttactccatatttgattcatagaaagtgcttggtaatcttgcttttttcatttgaaactgatatatattttttgtgcacatactattttattcagttgcctgtccctttgacaagagacgaagtaaatcccgctatctcagatacataaaaataatgtatctatttttaggtatttttacttagaaatataattttaaatatttaatagagaatagtatgttttatttatctaagacatttcatactttattagtataaactcctttattttgaaaaaatattataaatattatctaggaagcacatagataatcattttctgcattttgggtagtaggtaaaatgaaattccaatcatcaatttaggaggctttggtggtgggactatgtattatgtcacttacagatctccatgaagagagaattttccattctgatgcctaattttgtagtcatggggctcagaggctttcatttacatgattaggtattgtcttgccaataaggtcaaaagtttctgccctatgttcagaaaaatataatcttgttaggtttattttgtatctacatctgtgctgtgcccatctccaaagacagatttaagcaaagatgtatacaatgcttcataatgagatcattatagcttttagtgcttttgtcatctctacaattatcaggtgatatattttgtatactattcatgtgttgttttgtttgaacatatttttattgcactgtcttttcttcgataaatctttaaaatatgtcattacctgtgctgtttgtgactattctaagtgctgtcatctgttatgttcatactttgtgtttgcacgatttaacttgatcatgattcattcttttttccccatgaatttttccccttacattgtctccatattttctatatctctctccttttctcccgctcttgtgcagatagctcctccaagaagacaaagtctagttcagaggagagtagatccgagatatatggtaagctaatgtagctaattcagccttgccctttggagcttgcttcatggtgttccttttctgttctttttttcctttctttctttctttttaaataactgcagcctttcttgtgtctgctgtgcatggcatgatctactgcagggaaagggagcctggggttttaacgtggctgtgatgtggaagcttaaggttgctagaaactaacattgtagattaagagtaggccacattgcccatcttctcccgtcttgtttatggtaggaaggtgattatctctaatatgtttgggtcaggttcctccaaataacatgaatgggctttgaattcttgtcatcttcttcccacatctcatttgcagagtttggattatgaagaatttgaggaattaagtcttttcctctaagtataatactggtgtaatttagacgtattagcagttctttggaatttttatttcattttttgtttgtttatttttaattgcctcgtcatgtggaaaagtcattcttgtataatttatccacgatggcaaaaatacgtaagtattttatcttcatagcttgaagaatttgtgcctttgagaagtttctctgaagcttaatcggaatgggaaaatttcagaatggtaccttttaaataatcttaacaaagagcaagtttaacctgagtggtcaacttttgcagcagatgattgaaatgctaatatttctagactgtgtcctgtcttccaaagatacaataaccatgtttgtgaagttcatacctatttttccttttcctttgcagttttatttgccctctttccttcttttggagtctgattagggttttgttttggggtttttttttttttggttttttgttttttgagaaaagtgaataagagaggaattacctggagctaagattttaaaaataatttctgaaagactgataaattatttctttttttaggaagattccaaatttggcctcgaagggaaatcaggtcatctttaatagagccacaaatctatagagcagaagctcccccaggtgcagatagatgtttcctagcttgatatataggagaggaaaaaatacaggaattgccctcccctttttaagacatttgataattcacatctgctggcacttgagcccatatcagatactttttagtattatgaaagctcagtgtttggttctaaaccagttaattcttctatgttagatatatacacatagttctttacttgggtttttgtgaccagtgctttttctgtgtataccttttacagtagttcagcagtaaatgtatactgtgccttgtgacacatcaagtttacgctttttcttccttccagagtattttggctactgataagtaagaactacctaattcctggagactatatttctgttctatataaagagctttctatagtttatcctctccttaggaacatgaacattatctttatagctctattctttttcggtagcctttgcagtgttctatttcgtcttcctctccattttcctagatctgcgatgtgtatttagaagcttgttgtatgctttggatgaagactaacaatttaggaacctctgactagaaatactatactaatatttttcttagcagtgatagaaacattaatactagttcaggcatgccattggcttggtagtgatagaaacattttaagtggtaattgggaagtaaggtgtggcttctctgtgtgtttgttttttgagaacccttgaaataccttttttggaaggaactgagtccacaagtcctcaaaaagcactcatcggagggatgagttgattagaacagaattagcatgctaacgtaaatctctttgacattacaaatattttatcacctgtgtgaatagacgtctttagattacgtacagttagcatagatgaaaaagtctctctggggattcagaaaagcttgaaactactgagtagaatcatagcaactggtgacattctgctttagtgtagggtcttattataagcccacttcaaactttagagattatacattgctttctcggggtaaaattcattagctgagtacttaacaaaaatgctagttactcacatattatttattttaaactttcttggcttttttttttttttttttttttttttgagacaagatctcgctgtgtggcccaggatggagtataatggcgggatcatgactcactgcagcctcaacctcctgggctcaagtgatcctcctacctaagactccaaagtagctgggactacaggtgcacaccactgcacccagctgttttgtttgtttgtttgtttttttaatagagatgaggttgttgaaggaatgatttgccaggggaaaaaaaaaaaagaaagaaatagtagagacaaagtctcgccatgttgcccaggctgatctctgtctcctgagctcaagcagtcctcccaaaatgctgggattaaaggcataagccaccgcacctggcttcttagccatttttagagctactttgtgaactagatttactttgtgcatcttaaaaggaaaccaagtgtttgctttgtattgactttttttgttacatttctgcccagtgcggtcagttggttatttattccatttccccttatttgtccctttctacctgttagagtctattaaacgtgtatggatgcgttttctgatctacaattttaataatacttaattttattaatacttttgtgggttactgtaggaaatgagagattcagcaagggaattctgagttagaccatagctgctgcttaaccgctgtcatggtgtctgaacagattcctgctaacagtatttggttcaagaaaataagttatgtctttttaaagctgtcttagtgtgttcaggccactgtaacaaaataccatagactgcttggtttaagcaatagaaacttattttctcacagttctggaggttagaagatcaagatcaggatgtcagtgtgatcaggtcagaagattcccttgctggcttgcagatggctgccttcttgctgtttgtctcacatggcctttcctccgtgtttgccaatgccctttctttagtttctatgatattacatcaacctggttctttattctttgtaattattttgtctctctttatttgattgttttttccctcctgttttatacatgtaggcatgacccaagtttctgtccccaatctttcttccagtctccagtctaagtgtcccataaattcagagtgaccaaactggagttcatcattgttctctacagctggaaatcagtcttcctctttatttccctaattcttataatgacactgtcatttttccactcacctagtcttatatttccttaaagttatatttgacttctccattttccgtcgtcccctgtggtcagctatttgccaggtccccttgattctaccatcacaatatttttcatccttcactctttggtttcaaccccactgccttgtccatcattttattagactattataatagattcgtaacttacttttatttcagtttcacattgattcattaacttttctccattctatattctgccttgacttgtcagattaatattactaaagtaagaatttggtcattcacttgctaagaaagtacaggtagttattaagataatgccacaatttgtttccaatttattctactctgattctccttcagcgtttcattttccaaaacatgttttggcattcttcctttgcacatgccatttctgttgtcttgagtgaattaccacctataacttagaatcctactcatctttcaaggcttaattcaagtactgccttttcctaggattgcccagctacttttgttgtttctgaatgttgacatctgttttgtatttaattacttatatttatgtttatctttacatctcccataatgctgaacatattggagacactcattaagtgagttttgaatgaatgattgttgagattgacataggaagtattttagtagagaaaattgatggaataagatcttcactcatcctaattgaatctttctttccttctgaaaaacttgaagatagaagaaaatgtaacttggagacatttttctggtagtggtctgaaagaatgaaatcagcatacttggaatttaaggctcttcttgctggcaagactgtgcatttagaatcaagaagcttcttaatcaaaggattatctgaggtcttactcataaaacatgtatgtctggcaccagtttaaaatgagctgtttttatgaggttgcacatggcccttctccactcccttccctgaagctgattcttaagagctgaaacctagagaagtttggtcatgaaataaaataaaaggtgaagaaagactaatgtgctttcactaaagtcaatgtaatatggaagatttaacaggttatcttacatgtttaacactccattttcattaatatgccccacaccctattttcattataggagttatggccttctttcaggaacagttatagaatgacacttcatttttttttcactttcaaaatatgatcattggtaattatctattgagtaagaaggaagcagtctttttatgttggttttaagtgccacattgtaataacagaaaaaatatgtcttttgttatgataaggaaataaaagaaatggatagtatttatgtaaatttgatataacatctttacttcactgatgagatgaagcatgatatcaggtttatcagcttctaggcaaaatatgatttttaagagacaggaaataaagtttgttttgtaactagaggagttattttggggtagatggaaaaatcaaattattatagttggaattttgccagggcagaaggttaattagcgttcttatagaaatgttcctctactttgcatagtcttcaaggctgtgattttttttctaattagaaaatgtttgagtattttatttaaaatttcctttgtgtataaaattcaaatttatttaataactatttagtgagcacccattacatgccaggcactatactaaggcatagagatacaaagatataagtgactctacctactttctggttgttcacagtctggtacaaaagaattgcaatacattttgataagtgcagtgatagagatatgcactcatttaccattactctatatgcacttaaaaaaacagctgtgaagaaatactcatatggcaccaagaacaatgggacggaagaagtattactaggactaagtcttttgtttttttgaaaaacgtgtttattattactgttattttttgtagagaagaggtcttgctaagttgcccaggctgtgctcaaactcctggcctcaaccagtcctcttgccttggcctcccaaaacgttgggattacaggtgtgatccacggtgcctgcctgtcaggattacgtttgaaggaagtttaactttttataccagtctcactggttttactttttgaacactctgcctgtgtctatgcaaagtgctggcatatagcacatatcaaagtaattaggtggccttacagaactcatattcacagatagatacatttgtatggaagttatgattaataatctttataccagatgataaaggatttagcaacaaaacaaaaccatggactatatgagttgtagaaatcagaaaaagtaaaagtgatgaaagctggtttttgggtttttttttaattaatgaaatttgaagattgctattttggagttatgagtctacttttatctttggctttctctgtaacatacagggcctattttctgtaccattttctgattcttaaacattgtcatttttttctccatttgttttcagtattgtcctgccaggattttatgttctttgagaacagaaactccaagtagtcttgggttcttcacagcacctatgaactgcagtgttaaataactagtatggacagatgctcaatgcaaatttgctaaaacaaacaaaagaagtaggatttttgtgtgtgtatgtcaaaaaggatagtacaaagatatgataatgtagccagtattggtgattttagttctacagagggtggaatttttccctctgtggtaggttaaaacagcttctggtcaacaaatagaatatttctctgaagaaaaagggaaaacatttcatttgattttgaatgagagggaacataatagatttgagcatttgaaggactggatttctgaattttgaatggtaggatggcttcgttttcagttaattattaccacagatctaaatttatgcagacaccacagatagacaggacagaatagtattgttaatttgaattttatagattctgaattgactgtatgtgtaacactttttatattggtctactgatttaaagtacatgttaaagtacatcaatctcacattagcaggtaaatataaaataataaatgtggctaatacagtggatttggggagaagaaaaaattgaataggatgtgtgcatagttctttttccttttcctctttattctttgtccctcatctccttttgctgtagaattaagagggaaggttatcagactgagactgttatgaattggagataagagatttgctgtattctgaagtaatactaataggttttcttgattcttattaatctgttaggattctaggcatatttataaaattgactgtgcatggtgctgtttttttctctccgatgacctccctttctgagcttcctttcatctctagacttgtctacttgtctgaatttcattaattcataagcaatttttttaagtttccttctgtcccagaatacatgcaaggttctgagataagattgtgatgaagatacagcccctgcacctttggagcataaaatccaatgaaagaataaaaacaaatacaaatcagtgtgagtaagggtgatacagtaggagtacacagagggtgcagtgggagtctgtaagaggggcacctaacttcagtatgcatatttaggaaaagcttgtaagaagactgattcttttcttaaggacgtccagctgtctctcatcttctaaagctgcctataacaagaagctctgcccttttaaatttcccttctgtcttccttacccatccaaaactactttccttgtttgctaaaaaacaaaacttagacataaatcataattgatcctcttttttttttgagatggagtctttgttgccaggctggagtgcagtggcgcgatctcggctcactgcatcctctgcctcctgggttcaagcgattctcctgcctcagcctcctgagtagcctgggactacaggcacgcgccaccacgcacagctagtttttgtatttttagtagggacagggtttcaccatgttggccaggatggtctcaatctcttgacttcgtgatccgcccatctcagccttccaaatgcgcccagccagaattgattctcttaaggatcatttgcattaattgataggagtttattaacataaaagtacttacaattgtactagtagcatggatagaggagaaaatccaaggtcaacctccccttaatcataataaaataatatttaacgtgtaggaacccttaatatttgttagacattaagctaactactttatatatttttttattcaagtgagaggtgcaaacatagcaaactccttgactccaaatacccgtttccctcatgttttacaggtgtcctgttctctgcaggcatctgaaaaaaggtctatttaagaagcccaggttgcttagcactgcagtcacccatattagaaacctttaattcattaattttcagcttttgtgaggtgaggtgggagaatggagaagcacgaatatagtatgaaaaaacgtattcagtgttataattgccttgatttctaaagtcacagtatctaatttattttgaaatttcaaataactataagggaggttgtgaaatatttgtttccaaaagcaagcatggattttaaaaggttcctgtaaaatgctgcttagtctaataattttttttttttttttttttgagatggagtctctcactctgtcacccaggctaggctggagtgcagtggtgcagtctcggctcactgcaacctccagctcccagattcaagcagttctcctgcctcagcctcccaagtagctgagattacaggtacctaccaccatgccaggctgattttgttttatcatgttggtcaggctggtctcactcctgacttcattcaggtgatccacctgtctcagcctaccaaagtgctgagattacaggcatgagccaccatgcctggccagaatctctgattctatttattatatgctagaatttataaagaatgctttttttaaacttgatttatatattcatatcctattttataggtgtcctaattacttgaaggaagtaacactgaacagataacaaaggttgaattctaatgtgttatcacctgacctcattacaatttattgttttgtgagagtggtgaatatgttatttagtatttagaagtctctagaatttaggggtaacacatttttaaatgttgaaaatcaactttattgaggtaaaatttacataaaataagatgcactaattgtaagtgtatggttagaaaattttgacaaatgactatgcatactcatgtaaacattatcttaagaaacagaacatttccatcactgcagaaagttccttcatttcattttgcagtcattcccactcctcttccgtgcttctcccctaggcagttgctattctgctttttgttgttttagtttagtttttccttttctatgttggagtcatgtagtgtttactttcttacatactggtttcttttgcttaccatgatgtttttatgtttcatccatgtttgttgtatgagtagtccttttcttccttcctaatacattgtatggacatacgacagtttgtttatccattcatccgttgatagacatttgagtttctagttttgggctcttatgaataaaactgctgtgaacatttgtgtatgtctttctgtggacacaaattgttctttctcttcagagtaaaattaatggatcatatgcaaatatatgcttacctttataagaaatttccaaacagttttccagaatgttagcacattcccaccagcaatgttataatgttctaagagttctagttgctccacctctttgctaccactgtttatgattagccagactagttggtgtatagtggtatctcattgtggttttaatttgtattttcctgacgactgcagctgttaagcacctttacatgtgcttattggccattggtctatctttgtaatgtgtttatttaagtattttgccccctttaacatttgtcttccattattggctggagagttgcatataatctggatacaaattctttatcagatatccatattgtgaatattttctctgtggtttgccttttcattttctttttctttttctttctttttttttgtgacagagtctcgctctgtcgcccaggctggacccgcctcccaggttggacccgcctcccaggttcacgccattcttctgcctcagcctcccgagtagctgggactacaggcacccgccaccacgttcggctaatttttttgtatttttagtagagacagggtttcactgtgttagccaggatggtctcgatctcctgacctcatgatccgcccttctcggcctcccaaagtgctgcgattacaggcccggcctgccttttcattttcttaccagtgtctttagaatagcaaatgttttaaatttttgtccagtttcctaggttttttttcttttatggtttataaacccaccctaaggtctttttttaatgttataaaatattttgttacatgtattttatctgttttctttttctttctttcttccttttttgtttttttaataccctaaggtcttgacgatttccttttgtgttatcttatgaaaaattttagcttatgtttaggcccatgatctgctttaatttttgtgtaggtcatgagttcaagggttaaggttcatgttaagctacagtaggctcatgtactcatgatgtgtcattatcagcaaaaatagatatgtatatacactgtgtgtatatatatataatttgttatatgtatatgttttctatgagccattgtacacacagtctatatatattttttattaacatatctttagcatatcgtttggttggtaaatcagacttatatttaaaagattgtggctttttgtataaaaatctttagaaaaagtttttattttctattcattatctttgtgttgttttacctgttttatatattgacttcggtgaaatgcttagatcctgcaaagctgaaaatatatgttgtctctggctaacacagagttcaagatcttcagatctggtctatgataaaacagccctgggtactaatcagggttctaccctggcaggacatttctattcctctggctggggccctctttctctcaccttgccctgacagttttcatttgctgtttagaagaaacacaaattctcccttaggaatcaggtaagtatatgaaagagatgaaggaactggttgagctcacagattctttatcttttctatttttttctcttttctgtttctgttttctataagccagggtttttcttccccctgaactcttcctttctcttcccttctttggggaataacttcaggtactctgtaagcacctcctttctttttactgttttcctgagtatattttcttgagagtgagactggatttctgcagaattttccttgagatgctcctagccccatgtcctaagatggttgatttttcttgggttaaacaccaattagggtaccaaaaactcagggcagtggggcagggggagaatttttttactacagagaaatagcatggatgtgaatgggctttccttctagctgtctcatgtctaatacttaatattttgcagtttgccatagctgtttttaatattggagcaattctattatactccgccagtgagaaaacagtatgtgtgactctgtggtgttcttgtgtttgctttgttgatggtggttagtgttcttattttaccatgtggatttacatgtgctactttttgtttctccagatggaacacagtttattactaatatataattattgtcttttcctttctctgttttctcttccttcttgttttacactgtggttcttgtgcaggtcttgttcagcgttgcgtaatcatccagaaagatgacaatggatttgggctgacggtcagtggagacaatccagtcttcgtacagtctgtcaaagaaggcaaggcattttaaaaaacaatttatcactcagtaaacagagtaagaatagaaaagcttaaataatggcaattgccaagaatagaataattacatagattgcaggtcatgtggactattgtgctagattcgtctatcatgtcatagttacaggaaggagtttactccagttgatttttttttgtacttgttagaaagaaatcagtttttatttagttttagaaatcatgtgactccttggtcatgatactttattgtccacacaaaagtttctgaaatttcagttttccatggcaccactgatattttggcaaagacagattaaagagatagctatggcttcagaaataccatttattttcccaaaacaacagtgataatattttctactgctgttaccatatattgaatacttcctttatgttgggtgctataattttgaggtagacaatttttttatccccattttataggtgatattgaggcttagagtaaagaaacatcaaatcagtccaaggtcacacaactagtgagtggcagaagcagcatttgaatgtaaagtctgactttacagccttgttttttttttttgtttttttttttttggagatggagtctccctctgtcaccagactggagtgcagtggcacaatctaggctcactgcaacctctgcctcctgggttaaagcgactctcctgcctcagcctgccgagcagctgggactacaggcacgtgccaccacacccagtgaatttttgtatttttagtagagacggggttttaccatgttggccaggatggtctcgatctcttgacctcgtgatccgcccgcctcggcctcccaaaggacagcccatgtttttaaccagtttgttatactgtctctctgtcaggaagatgatcagtaaatgcaaatgaatcacattttaagcaattaatttctcatacagatggagcagccatgcgggctggagtacagacaggtgatcgaatcatcaaggtaaggaataggctattatagaatttacggtaggattaaaaaacaacatatattggtcatattctgatttttttcacttggatttttataaaaagcatcatacttctatgtatgatagatctgttgactatacaaacttatttcatttgttttaaaattaatactaccctttactgaaggacgtaataaaaggattgaaaataatggaggaatatatgttcttgagtaggagagtaattcagggttggaaagatcatttctgtctagattagtctgttattaagcaattctcatcaaagtacaagttgaacatttctaatctgacacctgaaatgctcccaactctgcaagtttttgagtaccaacatgacaccatgaatggaaaatttcacacctgacctcatgtgatgggtcacagtcaaaagttggtttcaccaggtacagtagcttgagcctgtattaccagctactcaggaggctgaggtgggaggattgcttgagtgcaggagctgagactgcagtgcactttgatcatacctgagaatagccacagcacttcaacctgggcaatatagtgagaccctgtctttacaaaacaaataaaaccaaaccaaaacaaaaaacttggttccatgcacaaaagtatttaaaatgtataaaactaccttcaggctatgtgtataaggtatatatgaaacataaaaggctcatatttaaacctgggtctgatccccaagatgtatcattatgtatatacaaatattccaaacttcaaaaaaatccaaaacacttcttctggtaccaggtatttcagataagcgatacctgacctgtatgcaaatagaattgtagtggtagatgtctatctgattattcttccagatgaactttataaagatataagaatcactaaagataaaaacatgttatatgtatgtgtatgtatgagaagagatgtatatgactctaatctagatatagacctaccagtggaacacaacagagagactagaaatagattttgaattcagatcagtagagaaagaatgggttagttagtaactattctttaaataattgactaatttgattacttaaaatcaaattattacataagaaaacataccatgaaaaataatttggaagaaatatctgaaacgtatcacagaccagatatccttaaatttaaagaacacttttaaattataagaaaggaataaatattctaaaagaaaaatgggcaaagaattttatcaggcagttccctaaagtaactgaaatacataacatattaatgaggatatggccaacctcactgataacaaagaagaagaaattaaaatgataggtgaaaaatacatttggctgtcagaaaatttaaagattggtaatacacatttagtatagtttgggtatggtaaaatgactattctcatgagttcgttgtgagtataaattaggtaaaacctgtttggatgaaagtctgtgaatatgtatcaaaagcctttaagaaagtatataacatgtgacaagcaattttgcttttaggaacttatctgaggaaataagtgtacaaatgtgaagtcgtgtgtacagggaaatttgtactggctttattacataactgtgcataaactgagggacagagaaataaattatattccatttgcagcttttgaaaagaatggattaggtcagtgtgtatctttattgaaagatagctgccgtacagtgaaaaaaaagttttattttttttttccaggaaaaagccagtcgtaatgtataatgtttatgtgtctctttggtgtgtgtatactagaaaagtgtctccaaaattaaatgtcatagctaacagtaactgcctcatggggcaggatgagtatacttgtacttctgttttttacactgatatatttgtattttagataacttggatcagagaattaatcagaaaattaatgttaaatccacatttgatagttttgccttgatttgtttggtttaattcagaatcgggataacattttctacatttagccggtctgaaaattaattttctttgtgaagattagatcatggttgaaaaactaaaagcaaattgaatattgtggaaatacttattttaaaaattattttttattattaattttgacaaattgatgacttggtaattaaaagcaaagagatcttttctatttgtatgagcccttcaccgtgaacgatttgtaaatctgtttcatgttatgttttgtcatttgtcatggtgaataagttgtactgttttgtatgtcaaggcctcggtttatgtttaagttcattttgttgctgaatatgccctgtagaatcatggtgtgaaaatgaatattgaatcaaatacataaatattttaatgtaatgtgattactatattatattggttatattatgtatgataattcttgaagtcattttatccattgtctcaatagaatgtatctgacatacactactttcgttttcttacaggtgaatggaactctggtgactcattcaaatcatctggaggtggtgaagctaatcaaatgtaggtgaatgttattcttagttttaattgttttctgaaacccttaaagtaaggagcagcaaatttcctgtaataggccaaatagtaaatatttaggctatgtggactatatagtctactgccgactctgtcattgtatcatgaaagcagccatagactatatgtaaatgaatgggtgtggctgagcttcagtaaaactttatttgccaaaagtctgtgatcctggtttagccccttggctggagtttgctgatccctgcattgaaggaaaatctgaggtgaaaactcttagcttactaatagctatcttttgtcaactccatttatatggttgattataatattcctgtcattcttggtaatatttgatacatatatttgaaagaaatgcatgagtcacctgagaggaaggaggttgagaagtcagacatatggcctgatgaactgaaatggaactttaaaaatcatctagcacaatcactttccctcagataagtaaatgattatataatccagagtagcgatcttctcttggaaatctttagggttaagaatttgtgatcttcaggtttgagtgaatagcccacttggacttagttctctgtggagaaacaggcttgaagcagtgggagtctgcagctaacctcccgtcacttgcagggtcaaaggtggattcacgaacctcgagctggcagtgagttatgggcaagccaggcctcagccactcacagggcctcagttttcccatctgcacagggagaagggaaggttcagtggccctgtgagctttgctagcaggtggtgatggggtgggtcatctgaatctgagtcaggtggaatcttccccaacctgggctttggtttcattttgttgttatcctttaaccttacctgctttccaagagagattttatgttttcttggttttttttttttttttgtttgtttgtttttagggtagggtcttgtagaatgcaatggtgcaattatagctcactacagcctccaacttctgggttcaagtgatcctcccaccttgttttttgttttttgttttgtcttgtttttttggtagagacagggttttgctgtgttccccaggctgctgtcaaactcctgggctcacccatctcagcctcctaaagcgctgggattacaggcacgagccactatacctggccaagattttatattttctaattgcttcacatactgaatggaaaatagcatgacagttataacagaagtaaagaaagtcacatgagagtccaccacctaaaatataacttcctttttctttgttctggcctggtttgggccgtatgtatttgttattgtatctcttaaaaaaaaaaaaaaaaagagagagactgcttgaactgaatgaaatttttttaaaaaaggaattaaaaaaagaatttatgatcttctgcatcagattattccacagtaaagtagactagaaataagagatagttgtttgtgatcaatcagaatcactactgttttatttaattctgtttctctgtattgggtggatggacatcttcaaaagaaatttaataaactaacttttttcttggcctttttactgctatgttaagcaactatgaaattttttaaactttttcatcagagtaccagtgctccaaatggtcactttgatcagcgttctttagtttaaaagagtgcagtgatcaaaattagatccccatacttgaataaacttgaccacttatttaatgagaatgtgatttataaattgttatgtgctgcataaatatggtttatgttaatgagtttatgcctgatgtccattgaggtgtataaaaacatttctttagctttctaggttatattttttgctcattccagtataaattttacttaaaaaattaaatcctgggattctagcaataaattacttacccaatagtaagggcatagctaaaaacttaaagtaaagcataaaaacctctgcatatccaaaactgatgtaaatttgacatcacatctgtaaagcctgggtgtatgtaacagagttcctgcatgtcctactttctaatgtgtattctggatataataaaagtgatatcaaatcagagcagtttagaaacagctaaagaaaggaagggaaaagctaggaagctattaaaaccaaatacataggcaagtgagatataatagatgactttctgatagagagcaataagattgaagagccttagaaagtgtttatatgtaaaattcctccaaattataacacttgtgagtattatacatagcaaaactagtttttagaacaccaaaacactgtgaaataattgataatgatttccatgggagggttaaattgggagacaagtgtgaaatacatttaaaagttctattgaaatatctaagaaaaaagttttgccatatctattactgactctgattatggtgtttttttttgtttttgtttttgtttttgttttttgagacgaattcttgttctgtcacccaggctggcgtgcagtggcgcaatctcggctcactgcaacctccgcctcccaggttcaagtgattctcctgcctcagcttccctagtagctgagactacaggcatgtgccaccacgcccggctaattttttgtatttttagtagagactgggtttcaccatgttagcaaggctggtcttgatctcctgaacttgtgatctgcctgcctcagcctcccaaagtgctgagattacaggcatgagccaccatgcctggcctgattatggtgatttttgctgtctagattcccgccccccgcaatatgtctactgaattcctgtccattcctccaaatattttctactaaaatttactacttattattgattgtgtttttccctgttattgtggaatattttttggtcatactcattttgtaaagttaatttaaaattgcattttatgttctagcatattcactaaaccctgcctagttagtgtcatcttaaaatatgaagatctaggccaggtgctgtgtctcacacctctaatcctagcaccttgggaggccaaggcgggtggatcgcttgagctcaggagtttaagaccagcctgggcaacatggcgaaaccctatctttaaaaaaaaaaaacattgcagctacttgtgggggctgaggagggaggattgcttgaacccaggaagtcgaggctgcagtgagctgagatcgtgccgcggcactccagcctgggtgacaaagtgagaccctaattaaaaaaaaaaaagaagatttaaaaaatttacatttaagaaattaattaaacatagccactaatagatggttgattttaacactcctctaaataaagaaaatatataatatattcttggagttataaattttatttgcttttaagtaatatctgatcttactagtagtaacttgctatctgaaaacggcatcattcttttggatttttagggcagtcataaaagagaaatgacaaattagtttttttttctgtggagacatgatgtagcagatgatgggactgtcttacataactggatcttttagaactatcgaagattaagtagtaaaatggtataaaaagtttcttgacaatgttattttcccttcccttccctttttccgtctccccaccccaagctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggtaagaatggggaaatttcttagttaaatgctcagtcttataaggatgtgtttactttatatggagagttttcaagtattcggctgatgaactaattaaatttaagattttagaaaatgatttactaatataaaaattacataataggaatgattagaatattgtcatagcagatttaatttaacaagtattagacacctgccatatgtaaaacagtgtgccacccacagaaatatagttaaggtactctatgttcaagattatagtcatcttagaatgtgtacttttaggagggcggggatttttgtttattttgtttactgttacgtttccagtacctgaaatattgcttagcatgtagaaggtgcttaacaaagctttgttgattgagattaagtcaagagtatacaagtaactataatacaaggcagaatgtagacattatgagggcaaaaaaaatgctaagttctatgaggattcaaaggagggagaaagcacatagaagaagaacaataaatagaaggagccaaaaaagcatcaaatattgtggagaagtagctaggatttttggttggttggtgcctgttaaggatgtgcatagtgggagatgaacttgaaaatagtaggttgactatatattttgaaaagtcacatctcccaagctaatttacatgtaactagataagcagtaagaatccattcaatgttgtttctttttaagcaaaagagtacatgattatcctaggattataggaagactaatttggtaaaatattatagggttgtgaaacaaggagggatgatgggtgatgaattagggagctgtcttcatatttcaggtaagaggtactgggagtttgagctatgcatggggatcgatagtaaagatccaaatgagggaaagtaaaagatactattcttatactaagacaacttcatttctccaatatcaatatttagtgttctcttgaatccagtttagtaaaaatgaaatagaagggcagacatttccttgtagtttcttgtaagtgtcatgtctgaaagcctgtccacataacccggaagtaaaaacctaataggtattgataattggagccgaggcagaactttgtatgccacattttctctatttattttagcttcattttgtctatactggttgttgtttgttttttatctttttcttttctaggaggaaaacaatgtggttcataaccagaaagtagaaattctgagaaaaatgttacagaaagaacaggaacggctacaggtattaaatgagaagtagggctgtttacaggccaataaaaatgtgagtgggcatggttgagttggtgtttatcagtcacaatcaagcagcattgtaaccaatgccattagttatattattgattaagaatggactatttctgtatcttttttacataagtaattaattctgaaaatatttttataacttttcagttattgcaggaagattacaaccgaacacctgcccaaagattgctaaaagagatccaagaggccaagaaacacattcctcagctgcaagagcagttatccaaagccacaggctctgctcaggtagcatcactattacaagtgctacccaactttttgcaggagaattttcttctgggaatgtgtcagagaatgttgcagttgccttttttaaagttatttttctagcgtaggacaacaggatgtcctgttaaggatgttacagaagtaatgattaacaaaaataaatgtgggcgtctgattgtttgcttgctcatgagatcacatttctttgttccataataatttaaaaaagaattgagtgcttttgctttgatgtgacaaactactaaaatgtatttagatatatatatatatttatattttttgtggttcattctgccatcttaaaacagaatggcagttgatatgtttttaaataggaatttaagaatttacaacaacaggcattgagctaaatatatggacaagcattttcttatttaatctgcataacatctctgaggttacttatggttgttttcctccagtttacatatatacttagagagagttagagagattaaatgacttgtctgaggtcatatagctgcaaagtaatagaactggaattcaaacccagtctgaggatttaaaagcacattcatactcttaatgactatatttttattgtaatttaaaaatagatttcagtagaatttgctgtatagttataagctatagagataatggtctcataagaaaaaaaaagctcagcatttatatgttaaccagacttacattctgtaatattcagatttgggatatgtaaagcaccttgtacttcatcttaaagcaaagtagataaattgcctatacatttaaaataggtaaaagctgtttttttgtcactgttcccgagttaaatctgaagggaaggctgcatattcgcaaaagaattctttgagatcatctagcctaatctgcttactttctgatttaaaaaaattatgttataattgagaaacctagggtctaaactggttaaatcacctatacaaggccatacagtatgtaaggtcccctgacatcctggtttagtgtacttttcattccattgtttttttcattaccttcagtcccagtagcgatgtcacattttgagtgttacacctcagtaatgttgacagttttatgttattactaggcaaatataatattcttaccctgtttggacagcaatctaaatgcttataacctggccaggcgcagtggctcacacctgtaatcccagcactttgggaggccgaggcgggcagatcatctgaggtcgggagtttgagaccatcctggccaacatggtgaaactccgactctactaaaaataaaaaaattagacaagcttggtggtgcatgcctgtaatcccagctactcgggaggctgaggcaggagaatggcttgaaccatggaggcggaggttacagtgagccgagatcctgccactacactccagcctgggtgacagagcaagactccatctcaaattaaataaataaataaatgcttataacctgatctaaatgcttataataatttatgttatagtattatgtcctagaattggccattgattgacactctgaagcattggaaggtagttaacaagaaactatagggtaataacctttattaatgggcagacaatataaattatataaatataaattacataaattaacaaaccattttatctttttgctatatttagaagtttgaacttacattctttttaccaaaatatcacttgccctgtctttaaggtcatgacattttagaataccggaattagtagttatttatggattttactcgtagaattttaaacatacttgagcatatcagaatgtccaacttttagtagtctccatgtagattgtagtaccactatttctttatgcagcaagtaatgaaagttttcttttatgtgtttgtgtgcgcgtgtttttctttcatctgttttaggatggagctgtagttacaccctccagacctttaggggacaccctaacagtcagtgaggcagaaacagatcctggagatgtactgggcaggactgactgtagcagtggagatgcttctcggcccagtagtgacaatgcagatgtaagctttcagttttctaaatcttttttcttctgtattcttctttacagcccctttctagatttgattttaagtgatgtgaattagaggtgtcttagcactttttaccatccccatttttaatgtaccaatttgataaacagaaatctggttactgttatatataagcttttaattccagagttcactttttcccttgaacacccattgccaactgtttcttttacagggatggaatttcccagcaggcatcttgttcgtgggtagagaagttactaatgccagtgcatttttactgaaccgagagaccaactgttgatatctttaagagcatgttaatattccatttgtggtcagagtgactcagtcttgaatcatggggcactttgccattaccaagaggaaaaacctcagtcctgttagataggcttcagttaatagcccaggtttagtgacagcactttcttgattaacccagaaactgccagatgaacatgactatctgttaagatgataataaaacattttaagctgaatatgatgtaacaccatagacatatgaatacctaaaagctaagttcagtattacttacccagcaatactttgtaaattgtatgcagtggtaggaataatgacttaaatgtagatcaccctctttaaaagtgatgagggaagaagtctgaacgaatgttttgtaattgtgggtcatgaaatcaattttgtgggttgtatttcttttttaaaaaaagaataggaaatacagtgctttgcatatagaagaggtgtcacttcttgggacttttgttacatatacacacatctactatttaacaatgtgaagtttctctcttattgaaggttgttgttgggggattgttttgttttgttgttttttaaaaaggaagccgtggtctaagccatcattcaggctatctcttgaggcttaggcccaatgacccagttcctcatgcaaaaaacaaactgaggatttgtgggttttttgttttgttttgttttgttttttaaggtagtgataggagtcttgtgattgggttagctaaaggttttaatggaaaatttcaatttgggctcaaggaaaaaatggtagtcactaatatttgttgggtatatgtcccatacacggtgataaggttttatgttccttagttaattctcaaaacagccttatgaagtagtactgttgttactgtaactttacaaaagaaaaaattgaggccaaagggagttaactaactttccaaacttattcaggcaataggtgatctacttccacctagctccaaaataccagtaatcgaaatataaacaaaagcactgaggtttgaaaatgcgtaacattttgagagagcagtgagaattttagggcaacctggcatattagggttatagatggaatggctagagattatcttagaagccaaatcatgaatccaggttataaagggcttcaacttgttctagcagtacataccgcttttgggaatgcttttcgtactcttctttttgttttagtaatgcgtctcctcgctgttttcatggcttgtccctaccatgagatgggaagttccttgagagcagagggactgtcttgtctgactttatgtttccaaagtgtagcaaattgtaggcattcagagcaaatgatacgaatgagaaatttgaattttatcttgtatttagaggaatgttacaataaaacatgtgacttagaaatataaccttataaaagagtgaattgttggctgggcgccgtggatcacgcctgtaatcccagcactttgggaggccaaggcaggccagtcacaaggtcaggagttcaaaaccagcctggccaacatagtgaaaccccgtctctactaaaaatacaaaaaaaaattaactgggtgtggtggcacacgcctgtaatctcagctactgcagagtctgaggcaggagaactgcttgaaccagggaggcggaggttgcagtgagccaagatcgcgccattgcactccagcatgggtgacagagcaagactccatctcaggggtgggtaaaaaaaaaagagtgaattgtttagtatagaaataggcattccaatcaattaagactgtttgacatgtaattgatacttagtatttgaatacatgaaatcaatgaataaagtgggctttatcttgcatgcagaagagagacaccatcagaaacatatctgtggaaaatgatttggtgtaaagagggagatctgtaagaaaagaagactgcttggcttaataggaactttaacaaatgtgtgctgaatggataatagttagcatttattcagtacctactttgtgccagaggttgtacccaatgctttacagatactcttttttaacactcataataatcttaaaaaagcagtatcaccatttcatagatgaggaaactgaggccaaataaataaatgaatattgtggaaatccgagtgagaaatgataaagtccaagctaggctatcttctgaacacagaacacacaggtttaatttctacaagtgtctgaggctaaagatgtgttgcttttagcttatggatttccatgtttgtttcaattttaagtatggaggacccggtctgcttttgttgttgttttaacagtactttgagtcgcggttttacattttatcttttgaatcagtgcttttaacttttttcattgtcttctcatttttataaaataatttcctggtggtgtttgtgaaagttccctgcttttgcttaccttggagaaggctttaaagaatgccctgatacccagttctcacaagagaagcaacttggtaacaaatcatcatctgaaattcagagcatctatcattttgattttcagtttgtgagtgatatttttgaaaaattatttattttggaaaattgttaaacatattcaaaagtaaagactaacataatcctcctcatgtccctgagaacctagtctcagcagttttgtttgtaccccctattcctcacatcctccaaacaccagattaaagtaaatccaaggcattcgtttattaatatgtctctctctaagagataagaagtttttaaaatatagctataatattcttattaaatcctaagaattaatattttctcaatacacaattttattaccttgttttataatgatctttttacagtttatttgattcaggatccagtcaaggctttcatattgccattggttaataagtcattttaagtctttataatttataatagtttccttcttttttttccttggccatttgttgttgtggttgttgttaaagaaattgagtcagatgttcagtaaaacaatccattttctaattatattttcatggtgtcgtatgacatgttcctttatctaaattttcttaaaactcctagttaaatctacaagtcttgatcacattaggtttgatagttgttatttggaataattcatagatgatactatgtacatctcattatatcacatgaggatgtgaatggctgtcttactgtggttgtaagcttaaggtgtttaggtgatatcaacatgatttccttcattataacgtcccctgtcaagcttttttttttttttttttttgagatggagtctcgctctgttgcccaggctggagtgcagtgacgcaatctcagctcactgcaacctccgcctcccgggttcgtgccattctcctgcctcagccttccgagtagctgggactacaggtgtctgctaccatgcccggctaattttttttgtatttttaatagagacagggtttcaccgtgttagccaggatggtctcgatctcctgacctcgtgatccacccgcctcagcctcccaaagtgctgggattacaggtgtgatccaccactcccggcccccaagcttttgtgaaatgttttcacatgccatttatgatcaaaatgcctagatccattgtttaattcagagtttcaaaaggatattattataattttgtcagtatttctgtatttattacatggagttatgttacaaaaaatgatttcccttactagctaataggttaccctaaaatacagcttatacagaaaatgtagggtaaatacttctcttgattcttttcagaagagttttttcaggagagatgatactcttacaaactccaaaggtgacaagtgggaagggtatatgtgtgtaatattttgaactcatagatttcagtatgagttactcttttcttttgttggtgggagccccctcaaattttctcctgtgttcttttgacatgcccctccaatatctttgatagctttcttgctttttgtgacagaattattctaatcttttatatatcttgtccaagacctgaaagtcattcatttctccaaggtggggcatacatttgaaagtgctgttttctcttggtaacagaaatatctgtgataccaccaagatatcttgctatatgcataggtaaaatgtatcttccctattggcactcgttaggtctctggttcctcattttcattgctctaaagaatgtctcccgttgctttggggtgttcctcatctccacaaagtgagtttctgtgtctcatatagttcatattttatacagaagttctcagtatttgtggacagcatctgtggattcagccaaccatttatcaaaatattcagggatagaaatgcatctgtactgaatatgcacagacttttttcctagtcattatcccctagacaatacagtataacaactatttatacagcatttatgctgtattaggtattataagtaatctagagatgatttaaaatatatagaagatttgcgtatgcaaatactataccattttatatcagggacttgagcatccattcccccacaaacactgaagaacaactgtattaggtattatacaataccatataaatgtattaaaatccacctttcacatgaagcgagtaacagaatagtagaagcttaattgtactcataagtagggcaaaatgcttttagcttggatagaaaggatagtttgagaaggtaaggattaaggaagataagagagtttgattttgacataatgagtttgaggtatgcagtatatctaattatttggtagaaaagtaacctccaggcctggagattaggtaaaattgttttgttgattctgtattgtttatcaatataaaattgaaaaggtgagagaataagtgacttgccaaagtaaggaaaaagtagcagaaccaagcattttacgaaagatatttagtagttgtaaatacaaatatgaaattcagaacaatttttttttcacacttttttccctcatctccttttggtgtgcctattgaaatgaactgaagatcttgtttttttcattagagtcccaagagtggcccaaaagagagaatttatctagaggaaaacccagagaaaagtgaaacaattcaggacactgtgagtatgaaatccatgcaatgatagtgctgtctttggctttccttatacttaaagtatggtatagacacatctgatgtttacatattttattttttattttttggaaaaaaaattaaaatttattaaagaaacttaataaagatttgaataagtcaagagatattccatggtttgtaagtattcttaggttccttcatatttgtcgtggtggtaacataaaatgtactagtttaaccatttttaagtgtatagtggcattaagtatattcacattgttgtgcgaccatcactgccaaccatcttctccaactgcaatttggtacccggtaaacactaagtctacatttcccccttccccctagcccctggcagccaccattctactttctgtctctatgaatttgactactttagatactcatgtaaaaagaatgatacaatgtttatccgttcatgactggcttctctcacttagcatatgtcttcagctttcatccgtgttgtagcatgtgtcagaatttccgtcctttttgagaccaaataatattccatgacatgtatatacaccacattttgtttatctgtccgtttgtcagtgggtacttagattgcttccactttttgctattgtgaatatgctgccttgccttcagtttttgtgggtgttcatcaagaagaagaattgtttgatcttacgtattcttaattgcatgcttttaagcactctgattttatcttctaattacatttatttacagttttgtagtaaaagatacaacagcattttgtcatctttttattgttagcaacataaggactattgaaaaatcagagacatcaaatcagttataaaatcaaaattgtctgactactgctcgaaactaatttatgttgtttcacctaatttcttttttttaattttttaatttttcctttttttaaagagggagtttcgccatgttggccaggctgttctcaaactcctgacctcaggtgatccacccgcctcagcctcccaaagtgctgggattataggcatgagccacagtgcccggccagtttcacctgatttttttttggaatattaaagccttgaggttaaagaaaataataagagttgttaaaaggcagaattgtgtttaggagactcaatatgtagtgttgcaacactaggaggaaaaactacaggtacatattattcactcagtttaaaacttgcggatctgtttatacaacttcagctatagccactataactgctgtgcaaatgactctcaaatcataggcctacccttctttgctgaactccatccagatcttgcaatgttaaactgctgttagatttaagccaaactcatttttttcctatttcttccaaaatttttattccccaatcctatatggtctttaattttagtacttatggtcttcagacatcctgtatgtatgtatgtatttatgtatgcatgtatttatgtatgtatatatgtatgaatgagacagagtcttactctgttgcccaagctgcagtacagaggttaactgtaacctcaaactcctgggctcaaactgtgtacccactttggcctcccaagtagctaagactatagacacacgccaccacgcctggctaatttattttggtttttttagagatgggtcttgttgtttttcccaggctggtttcaaactcctggcctcaagtgatcctccctccttgacctcccaaagtgctgcgattacaggcctgagctaccgtgcccagcacccatgtttattattttatatattaatgcctctgtactgccgtttttgtgctgaatctaactttgtgagttgacaaatggaggagctattgcatgggaaactatctgacaatctacaatttattcttagaattttgttatctttgtttctatagcagtgtttgtgagattacttgatgattttagagcattgtatcagtgatttttcaatcaagagtgattatgcctccgtggacatttgacaaatgtctggaaacgctgcagctggcatctggtgggtgcatagaggtcaggggtgctgctaagtgtcttagaatgcacgggctagaccctacagccaagaactctctggcgcaaaatgtcaacagtgccgcagttgagaaaccctgcattatacatttatgaaaattaattaaaaatgaaaacatagagttcgatgatagccttcaattatgtatcattaatggaaatcttgggttagtacttctcaggtatattagcctctctgctaactttgtcttaccatttctgctcttatttttcctttctcctattgtcttcattcactttttctttaattttttaattgtaaccatttatgtaagccaactttatttttttctgtaagaagttttaagtatgtatgaattaataaaagaatgtacagaagtgtacagaaagtgttaaagtcagataaccaagtgtatagtgagcaaaggatatttactgtttccaaggggagtggttttttccccccaaaaaaaactcgttgttgtggtctttttctctgccagagtggtacatggccttgaaaatttgtgaacccctactttgaaaataaagtacttcaaaggaaataaacaaaaagaaatctcaccatttaagtgaaccatgtctttttgatgggttggctttattctttttctaaatttgaccaccaggtaatttttctgtttcttttccctgaatgttgccaggacactcaatcacttgtcggaagtccctcaacccgtatagcacctcatattattggagcagaagatgatgattttggtactgaacatgaacaggtgatgacttttttctttctaaaaaatagattgttactttctgcaatatctgatttgttgcaaaaatgagcacgttctggagattaagataacatttgtaaggatttgaagctaaatcttagaaccaatagctccttgggttaattgcttattttagctttgaccaacagaaatgaccttgcttttaaagccagtgagagatcattaatatatgtttaagtacttcattttattggggttgagtgtgtttcttaaaatagtatttttaaaaaaaatttcaaatcccagttcattggtgctataaaggaatatgattagctagattcttgtccttgtatcctgtgatcttgctaaattcacttattatttcttggtgcttttaaaaataagtcttttggagttttctacatagataaatatgttgtctatagtttttatttccttattttcaagctgtttatcttttatttcttgttcttgcctttattgcactggctaggacttccactatgaggttgaatcagagtgacaagacatgcttgccttattcctgctattagggagaaaacactcagtctttcatcattaagtatgatgttagctataagtattttttagaggctctttataaggttaagggttattaggttaaggaatactcctggtttgctgagagtttttatcatcactggatgttgaattttgtggaatgagattattatgtggtttttctgattgtctattaatatggtaagttatgttgattgatattagaatattaaactagtctcgcattcctggaatgaacctcagttggtcatgatatgttatcccttttatatattgtcggtttcaatttgccatattttactgaggattttttacatctttgttgatgaaggatattggtgtgttgtttttctttttgtaatacctttgtctggtttgatagttgggggtaatgctggtctttagaatgatttgggaatatgaaaattgtgatgctagtttacattattattgttttctgtgttcagtatatttagggattatacaaatattctaggatttgtcttacttaaaatcatacaacttcatttcccaccatttctgcaattagcccagaagaaaaggataaacagctattttatgattgggcaaaaagccttccactgcatttctagaaatgttagactgttttttacatactgatttgtatacatccgagctacttgataatcgtctcctaaatttccgttctcccacagtggtctttcttctaacctatccccaagaggtggttaatgttcacagaaagagattccatagcttctgttgctaataaattttagtgaagttttttaaatcttgaattttttatagggagatcaaagtgaaatttggatagctatgttcaattgagcctactttgcatttagtatttgtatgttggagttactgatgcataatcatttcttcctctagatcaatggacagtgcagctgtttccagagcattgaattactaaaatctcgcccggctcatttggctgttttcttacaccatgtagtttcacaatttgaccctgcgactttggtaatatattttacaatctagcagattcagagttcttctgttgattcatgtgccatagaacttttcctagctatacaacgagtgggcagacttctttcagttttccgtataaagacagatacaaaagataattaaaacattatttttaaagacttggttatatagtaataactacattgtttatggtgacctacctgttccagacattcctactcaatggtgacctagcaaattacatttttcatggttcctcattttgtctttttcattcctttctccactacagctctgttatctctattcagacctgtataaacataccaattccaaagaaactcgtcgcatcttccttgagtttcatcagttctttctagatcgatcagcagtaagttgccaagttaatgttgtaatctttgccttagtacatggaattattgtcctcctgcttcctatcttccctcccatgtttttggattttactgtgctttctcacacctgtattatatttcaattattgattactctagacttttttttttttatcatttctaaagtagtttaggcatatgaattctcacagtaggttttaggggattatatatatatatatacacacacacacacacacacacacacacatatatatacacacacacacacacacatatttgtgttttttgcatgtgcataattagagtgaggaaatgaaaaagggaatacatatatattaagacccaaggaataatacttgaataactgaactctgggtggcctctttgaagtttggaggcataattttaactaaaaagtggcagaaaagatttcacttacactgaaataaatgatgataacgttatattttgtcattaaaagtgttaataaggtttttaaagtagtaagttttattattagtcttgttatgggtaaatagcacctagcccttaatgcatactggataatcatgccgcaggtccctagtcctttcacatttgcagttcccttagacgactgcctcatgctttttccctcctaaaacctccatcacttcctttcctagtcctttctcagctgataaccttgaccttattgtttctctgagaaatttaaagtatatagaagagaacttctaccagatgtatcatctgccctcattataccataccatgtactctactctttctcctgatgctatggagtgactgtcttttttttttttttttttgagacagagtcttgctctgttgcccaggctggagcacagtggcacgattgcacctcactggaagctctgcctcctgggctcaagtgatcctcctgcctcagcctcccaagtagctgggactacaggtgtacaccatcatgcctggctaatttttgtattttgtagagccggggtttcgccatgttgcccaggctggtcttgaactcctaggctcaagcaatctgcctgcttcatcctctcaaagtgctgcgattacaggcatgagccaccgcacctggccttgattgtccatcttttatccaaggccagctctgctccagtttacagtgtatttccttatacctactcaaagatcttactctaacaattatcctcccttctcctgcatcatcggttttatattttctacagataatcattcacattagtctgcaaatgttgttattttccctttctaaaaacaaacacacattttggctctacttctccctccaactcctgccccgttttctttgtatgcctttacaaaattgtctgtacactttcacattcaattacctactcagtgactttcctaaccaacctacttaaaatctcaaccctttcactttgtcactttttctattatttttgtccatagaacttttatttagttagttagtttgtttacacagtcagtcttctgtgcctgcagcttccacgaattcaactaaccatggttgaaaatattcaaggaaaaaaacaaaagccaataccacaataaaaaatgaaacaattttttaaaaatatagtataacaactatttgcatagcgtttacattgtattaggtattataattaatctagagatttaaagtatacagcaagatgtgcataggttatatgcaaatacagtgccattttgtacaacggacttgagagttcgctgattttagtatccatgggggttcctagaaccggtaccccatgtggatatcaagggatgactatattcctactctcctaccctgaatataagttttattaggccagatatttttattctgtttgttcactgctgtgtccctaacactgaacagttcctgggacatagcggggtcacttaagtatgtgttaagtgaattagtgttctgatcctactcccattgtttaaaatattgtgttatttttattaaaataatttactttcctaaaaaaatgacaatatattgaagcatgtttgaattttgcatttcttaagagggcaccaagctaagtcaaaactttacattttgctacacatgatctatatatcaatattaaagtataagaagaatccttacactttgattaatttgctaattatacttttatgctacagctcacatttatttcatatatacaccatcatacagaaatgagcttttattacttttttgcacttgagctagaaatgcttttaagaaagttgatttgagctactgcctgtcaaagagaaagttttaaaatccattttacttttcttcaaatgaatataaagagatcttacaatttttagcggtgacttattttcaaatttaaaacttcagatcttataggatgtgtttaaattctgaaattgtatgacttaaataggtatacaatacaaaataagcaggaagaggttaagatattttctcttaatgcaaaataataaagtattcccctccattagtttgggggtgggggaaaacaacagactggtaattattatgcaaatattatggggaaaatcctagctaggaataagtaaattctaagatagtcaccttatttggttcagtagcaagaactgtagatggttgctggagatttaaaactccaaaaactcaacattgacattcaatattttctcactgggagtgtgacattgtgagggctcttaaactttacataggaaaacgattaggaatattattggtcttcagaatgagcatctcaaatataggaaagaaaaatcatggctatatgtgagtacatttttcatatgataatatacacataatttaggttttacctatattgatctaaatgacatataactgattatattgaccaatgattctaggaagccaaagccaaagccagtatattcattaagtgtgtcacagaagcattcagtcatctagctaaacgactgtagacttttcctttatagcatgatcctcgggaaaagggctcattttcaagtttaaacgatagaatgttctggagttgtgaaatgtgaatgaataaatgagcttgtacttgattgtgcttgtagagtgggtatccaagttgtatccccttactttacagaagtacttatgtacatcttcaaatatctttagcgttgttacaccttttgtttgcatttcattttagcacctgaaagtttctgttcctgatgaaatgtctgcagatctaggtaagcttggagcactaacatcctggagaattacatcttaatagatatgtagctcagctcatctgttcaggttttatctgtcacatggtgactagtcgatcacctgaatcacaacagaaagacagtctataatacatttaaagagtaaatgaggccgggcgtagtggctcacgcctgtaatcccagcactttggaaggccaaggtgggtggattacctgaggtcaagagttcgagaccagccttgccaacatggtggaaccctgtttctactgaaaatacaaaaatgagctggcatgatggtgcatgcctgtaatcccagctacttaggaggctgaggcaggagaattgcttgaacacaggaggcggaggttgcagtgagctgagattatgccattaacactccagcctgggtgataagagcaaaactctgtctcaaaaaaaataataatatggctgggcgcagtggctcacgcctgtagtactcccagcactttgggaggccgaggcgggtggatcacgaggtcaggagatcgaccatcctggctaacacagtgaaaccttgtctctactaaaaaacaaaaaagtagctgggcgtggtggcgggcgcctgttgtctcagctactcaggaggctgaggcaggagaatggcatgaaccccggaggtggagcttgcagtgagctgagatcgcgccactgcactccagcctgggcaacagagcaagactccatctcaaataataataataataataataataataataataataatagagtaaatgaaatcagaattctgggatgaaatatacgaactgccctgaagaacttccctctggcatattctaagttaatttgtacgaagtagcattgctatgttgccaattgtatgttgcccagaacatacctttagataacataattcctttcatttatgaagaaaagagaagacctgagctcattcctgaggatctgcatcgccactatatccaaactatgcaagaaagagtccatccagaagttcaaaggcacttagaagattttcggtaagcttagtggtagatagaatttcatatgattattctaaattaatttttttagttaagaaaaagttgctcattaaatacttagcttagcactagataaaccatatggtcttattgttattaaaacataatgaacatctggagccaaagggttagagtggaactgagagtccagactctccattccaggcacttgcaggatctgagctcagtgctgtgtctatgctaagtgtgttcctttaagatattgtatgtgttcttggagtcattgcttctagaattttttcctctggtatcctagatgacatggacccataagtggaaaagtgacatttttcctgttcctagaaaccatagctgtgaagactgtgatgaagcgtccccagaatgaggtagtttttctttaggctacctcaggaaacttctctattcccttcaggcagaaacgtagtatgggactgaccttggctgaaagcgagctgactaaacttgatgcagagcgagacaaggaccgattgactttggagaaggagcggacatgtgcagaacagattgttgccaaaattgaagaagtattgtaagtaatagaagtatatgtggaaatgccctctctgctgagatactagttatgcttgaagtgtcctttgggtaggtttagaaaaactgtcagattgtgtatgtggagccgtttattttgtcatagtacttgagaaactggattttttttttcttttttctgatacttttagataaatttcttgtgttcctttttctgggtggtggtaaatgggtaactctaaaacttctaatcagtgatcaaaaacaggttgattactttcattattttcaatttataggccttggaaatatttcttgccatgaagcatatacagttggtgacatgagggtgaaacagataaggttctttaggggatcagggttcttttggtattttattctagggtgtggcccaaagcatttggctctgttctgttatttcaggtatctgagttaataacaatttttaaggccaggcatggtggcgcactcctgtaatcccagcactttgggaggccgagcgggcggattacgtaaggccaagagttcgagaccaagctggccaacatggtgaaaccccatctctactaaaaaccccaaaattagccaggcatggtggcactcctgtaatcccagctactcagaaggctgaggcacgagaatcacttgcgcccaggaggcggaggttgcagtgagccaggatcatgccattgcactccagcctgggtggcagagtgagactctgtctcaaaaaaattaattaaacttccatatttcatttttaaatttttttttcttttttttaaggatgactgctcaggctgtagaggaagataagaggtaacataactgttttttttcccctagaattttaagaaaaaaagaactatgtttttttcctttcagtcctaaattacaatttatttcttttaacttacaaatacagtttgtggtctctctctggtggcttgtatgttatttgactaatattctactgttgtcctgagtagaattctcttctctgtgcaatgactagttagttctttagtgtttgtttgatttatttcaataattccaaccttggggttttggaaatcatttgatgtctttattctaccaaccctcccttctcagaagtcttaatttacttcgtcctttctcctccagctccaccatgcagtatgttattctcatgtatatgaagcatttgggagtaaaagtgaaagagcctcgaaatttggagcacaaacggggtcggattggatttcttcccaaaatcaaggtaagaatgaaataatgtaatagcatgttcaggccttagggcttctttacatttggttgcagtgtcttccatcatcttagtatttacttaatcagcaaattaatgctagtcatacaaacatttataagatactgtctctgttctcaagaaactcaaaatacagtgagaaatccagacatataaactattattagacaatgtgaaaagtgaaattagcagtttacaaagagtgctatttctgattctgttcatgccttatactttccttttactttgcctaaactaaataccccctgtgttgctacataatcgtcatgaacatctttagtggcagtagagtattctgtcagtttgtaattatttgtgtttttgtttagtgtttactagattgtaaagctgtatgagtacaaggaccttctttattattgtattttcaactgttagcaaaatgcttagtaaatatttgttgaatggatgaatgaattgtttagaataagttcctggtaaatgtgctataaaactaccctttgattttccaaagctgtcagtgataaagagtttgaagaaaacatcttgagtttgaggtgtacacggtactgtgtgcgaacttttaattagtgctctgtgtgcatacacacgtgtacgggttttcatttacacttaacaatttctttgaactaaccattagcattacactatgaaaatcgcaaaagaaatttactctgttacgtatctcttattttttgtacttcaactctagcaaagtatgaagaaagataaagaaggggaagaaaaagggaagcgaagaggattccccagcatcctgggacccccacggagaccaagccgtcatgacaacagtgcaagtatgttgaagtttgaagtgctgcattttcagtactccaggccctcttcacatcagaggcttcttcagctagaatgaatttctggagaaaggagttgttaggatgattttactgaattcccaatatgccttgtttccattcagcgttatttctgaactaagtaccccctatgttgctacataattgtcataaacatctttcgtgggctgggcgtggtgattcacgcctgtaatcccagcagtttgggaggctgaggcaggcggatcacaagttcaggagatcgagaccatcctggctaacacaatgaagcctgtctctactaaaaataccaacaattagccaggcgtggtggcatgcgcctgtagtcccagctactcgggaggctgaggtaggagaattgcttgaacctgggaggcagaggttgtagtgagccgagattgcaccactgcactcaagcctgggtgacactggagcgagactctgcctcaataaaacaaaaagaaaagaaaaaaaaaaaacgaaaacacacatctttagtggcagtattctgtcaaatgtccgtaacatagtttacttacctcttctgattctgtttccattcaacttgtgtttgttaaattaaaaaaaaaaagtgtgtatagatctctccaccacactgaacgtctctttatacatatttacttagtctccatatttctaaaatttctccacctctccattgtactttattttctgatttccctttcaccccaggcccaataaagagagataagctcacttgagatggctgcaggagaaatagggatggtggtaccatggggaggggtcatgtgatggttcttatctcaggcagtagcacatttgaaaatactgaagccaggtgcggtgactcttgattgtaattccagcactttgcaaggccaaggcgggaggatcacttgagcctgggagttcgagaccagcctgagctacatagtgagaccctgcctctacaacaagaacagccaaaataagctgtgtatcatggtgcatgtgtgtagtctgagctacctgggaggctgaggtagtattgctttagtctggggagtccaggctgctgtgagccatcatctcgccactaaactccagcctgggtgacagagtgaaacactgtctcaaaaaaaaaaaaaaaaaaaaaaagatattggcatggtagagtggtgggagtaggattgtgatagtgagtgtcccccacaatgacgagttctccctcaaatgccatgagtgcctcttgttgagaaacattgagaaggtgtgaaatttttagaggaagttaaagagatggaggatttcacagatgctaaccgtgagttccaaggtatacaaaagaagaatttgaggaattaagagattagggtataaaaagttgtgtgagggtgtaggatgctttggatattgaacacctgagtgggagtctttggcttcttgtggtgactttgtgaacaaggataattagcaggatggggattggtctggatggtctttgaggtacattatgatgatgaaggtgtgagtgttgggggagaactggggtgggagcttactaagaactcacaaaaataaagacttcatcttcattcttacaaatgaacacagctccatgtctctcagcattcctcctccctctgtccaccattcctctccttcttttctcatgacccttcttctttccctacatcctcctcttcctcgctttcgtcgtcctgcctcacccctcctccatctcctcatctttctgctctaccttcctctccctttctctcttttcttcttccttccttcatctgtctgtctgtatgtttctctgcataacaatccactatatatattttttagggtctaccatgtttcacacattttaccagattcttttacattgtccttttttgcttttagctaatttgcaatgcagattattttatttattttatttatttatttttgagacggagtcttgctctgtcacccaggctggagtgcagtggcgcaatttcggctcactgcaacctccgcctcccgggttggagcgattctcctgcctcagccttccgagtagctgggattacaggcatgtgccaccacgcccagctaatttttgtatttttaatagagacggggtttcaccatattagccaggatggtctcgatctcctgacctcatgattcgcccaccttggcctcccaaagtgttgggattataggcttgagccaccgcacccagccgcaatacagattattaaccatcattttctgatcagttggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggtgagctattactgtagttcagcttaactaagcatcaagattttaaaacaaacacactaactgaaaaatagagtggcaagttaatcaagactaaatcccagtttaatttaattttgacattttaatatgctacaaccaataagaaatctatgccgaatgataacttaagttctcatttgtccaaaaaaatatttattaagctctctgtcaggcattagctttgtcccggatgttaacatgcaataattatacacagatgcttgcctcatgcagctttctctcttgagagcgatagtcacaaatgtaaaaaatgcaaattgtgccaagtccaatcaagggaaggtaaagggagtattgagggaactggtcagtagttagaggcagatgtgggtatctaaagaagactttttaaaaatctgagattaactagaggttttatttttcaatgttaataggaagccagctgaaagaaagggtagaatatgtgggagacagtatataagtagtagaacagagttgtgaggagagaggagatgagatgtagagtgtatgtaaagggtaagactatttactgagagtgagagttcagtgagaagagcaagggaatttgaagagtaaagaaagatatgaagcaatcgtaggtaattgggcaaggagcttattaccatgtcttcatccttgtttgggaggcggttcaatttctggtggtgacatgatcaagaatgaggctctgggagtggtccctgaggtgccatagaggaggctactagggatgaagacggcaaggaaccaagaagccaggagtttgaatagcttaatattcatggctagtgacgtcaccaagtgtgatttttatcatggagaggaaaactgtgagccaccagccaaaggtttagcattgctagatgattgatatgaggaggaagagaatgtgataatatccagagcatgagagcctcagtggagcaagagattatacaggaagacaaggtcgggtgcagtggctcatgcctgtaatcccagcactttgggaggctgaggcgggtggatcacctgagatcaggagttggagagcagcctggccaacatggtgaaacccggtctctactaaaaatacaaaaattggccaggcatggtgacatgcacccgtaatcccaggtcctcgggaggctgaggcaggagaattgcttgaatccaggaggtgggtggaggttgcagtgagccaagatcgtgccaatgcactccagcctgggcaacagagtgagactccatctcaaaaaacaaaaacaaaaacaaaaaaaaacgacaagataatggtccaaaaatcatattgaggaacaagaaggccattcatctcatctccaccctgacatacaccatataagacagaaatattagtttctgtctcagagggctgtagcagaagaggtaagctgctgggaataggcaggtttctacataaggccaagaagtacaagtgacatttggagaaaattctggggattttgtcaaatatggaactctgaagatgttagattgggtatatgcactgatatttcatggctcctgtgacttattaaaataaaaacatggtaggtggcggatgaacagaaaccataaagagaaagaaagtagaggaagggaatgtgttatcaggaaataagagattttaacaaatacttgggagattgaaagcagacaagagtgtaaagaagccaggcatggtggcttactcctgtaatcccagaactttgggaggctgaggcaggaggattgcttgagcctagaaattcaggaccagccagggcaacatgaaaagactgtctctacaaaaaatgaagaagtcagccagtcatatggcatgtgcctgtagtcctagctaatcaagaggctgaggtgggatgatcacttgatcctaggaagacaaggctgcagtgagccatgttcttgccaccgttaatgcagcctggatgacagaatgagaccctatctcaagaaaaacaacaacagagaaccacaagataaaaccataaaggaagccagagcccacaatttgtttaaacagtccaagatagaacccagtctgctcattggaaccctggagagactttgggctcagagttagcatatgttatgcagtgcaggaataagaaaaagagcaaaaatgatgaactaattgcaggtctataatcaaaatagttatatcagcagcttctaatccctgaattacagagtatgagcagtctctgtcacttgtagactagaagaaaaaaacagtgctcttttttaaaataattcagtgaattgtgtagggagagttaagtccctccgcagtattgatcgcttggagttctgacatttgggagtccaaagcctgacactaggcatgccggcaacccactgtgctcagagagctctcaactgaaacagacctattactatatagcagcaaaagaaagccaagtcagctactcactttcatcattaaacacgaacatcattactcacccttgtcagagtcaagacgtaagataatatataatgccaaacatatcagacaatgacataaagagagaatacagttaaacagaagaattttccctacaagagaaagataatctgataatagacaagaacttaagaaaatacttctaaattaggtagtatacttggggacattaaagaagttattatctctataaagcaagaatagggagcattcagagacaaaatatttttaatacaactattaaacacagtgacatctgttgtattatcaatttctgtgtgataaattaccccaaaacataatggcttaacacaaaaaaaatttatctcgactttttggtggatgaaggactccagagcagcttagctgcgtgggtctcggttggagtctgtcataaagttgcagtcaagatattagccagtcatcagaaagcttaactggggctggggaacccatttctgtgcccactcaggtggctgttggcaggaggccttagctcctcactcatggccttggctccttgccacatggacttttccatagagatacttgagtgttccatgaaatggtagctggcttttcccgagtatcccaaaaaagagagcgaaaaggaagccccaatgtcttttctgacttagtctctataggtgcactctgtcacttctgcaagttagaaacaagtcactaaatctagcccatactcagggagggaggaattaggctccacccctgaggggagaaatatcaaaaaatgtgtgggtatattttcagaccaccacagcgatcagagtttaaaggaaaaaaaagaagtccctaaaattaaagtcaaggaaatattttagagtgtacatcagaaatatgaaaggatagaaatttgagagaaaagaattatatagggaaccactacagagagccaacatctgtctctttcacaaaaagtcagctgaggacatggagaagagatggttaaacaacaggagaaagtttcccagagttgaaaaagaatacccatcttcaggtggaaagggctcactgagaaccatctatagtgaatgctttttaaaaaatccattcctaacatgtcctttgaaactgtagtgcaccagggataagctttcagaggaaaaaaaatggggattacactgcatcacattcctcatcataacactggatgctgaaatacaaaagagccatgccttcaactttctgaaggaaaatggttttgaacttagaatcctgtatccatccaagctattcatcaaatatgaagaatgaataaagacattttcagatacacaaggtccacagtttaactggaatgtacctttccctttgaaatcatttgaggatacacattctagcaacatgagaggaaaaattaagaaagaaaatgtcctgggatccaggaaacactggaaacacccaggaaagtggcaaagggcaattctaaaatgatggttgtgtaacaggccaggagagccactgctccagattggaacacaagaacatcacagataagaaaatggggattttaggcagtggatagtatgaagcagcagaggaaatagtttgagacttgatagaattatataactttgacagcaataaaagaaaagcatttagaaatgttaagaaaaacagaattgttcaggaaaataagtcatgatttaaacatgaagcaaaataaaaagtggcatgatctttagcaattgatggtgtgtaagaaagactttaataaatgttctatttgaagtggcccatggattgcatcattggaccggtaggaaaaaatatataatcctaactagtatatttcttaatctggcaggaatgatgtatatatgtatgtagtagacgacagtatatatatgtcataagcattctttcttggttttcagacttttagaataaccctaccaggcaagcatggagtagttcattatggctgcaggttagaatataaatgtaaaaaattcttttaatgatgcaagtaaaaatgtagttgaaagaaatggaaggtagaaggaaggaaatacaattagagggaggatgtggacactgaatacctaatctgacacagaagagagttgagatactaactttttgatagaacaaaaacatagacatgtcatttaaatttaggtagtaactaataacccagctagtaataatgataaaactattaaacattgggaagaaatggtagaaaagtgaaagtggaaagtgtaagtcaacaaaatcctcagaggggaaagaaatagatattaactaaagataataaatcatgaaaaagaggttatttgtagttggaccactgtaataactcacatttgaaaacatgaaaaaggattgatactgggagtagaaaaggataagatgggaaaatgttgttcctcatcatatactcttctgcactgtgtgagtccttgctatttcttacgttaatttttaagaaacagttttaaaaattatttttctgaccaggcatggtggctcacacctataatcctagcactttgggtggccaaggcgaaaggattgcttgagcccaggaattcaagactagcctgggcaaagtagcaaaaccctatctctacaaaaaaattaaaaatgagccaggtgtgtgtggtggcacgcaactgtaggccccgctacttggaaggctgagatggaaggatcatatgaggctgagatgggaggatcatgtgagcctgagatgccataattttgtatattaaatttttagttctagtgaacctgcagttgtttaaataagaatgtagctatggattaggctgaagctgttctgggaactaattttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatggtgagtgtaatcaatttgttgttgttgtttacaaatactgagttttgtcagagtgaattaagtctctcagccttggagtttgcttcaaagtttctcctagccttttgttttaaacaaagaggaaattaaactggacagataatccttgaactcaagaaaatgcaaatgtttctctgattcttattgataatttaaaaggaaaatgtgttaagccttaaagatatttaagattcatagcattatagatcttaaagttgaaaagtcattgcaacaactaagttatttttatgcatagattttaaatgaggaaggtaaagcccagggagattgaattcgttaagatcatacagctaataacgtgtaaggaaaaaaattcagttcctggtctttctgtatcgaagtgcagtgttctttatttaccctagcatgtatgtgataaatgtgtggcatgggtgctgtaccctttactatccttagcatgtgatatgaataaatatcttgtctctgacaatactgagacataatgaaattataagcctgaccccagaagtgagtgtttataggcaaattagataaccaaaagtactattatttcttaagagggctcaagttaaaggctatatgatgttggggcttacagttttcttaatgatgtagttgtgataggtgggtattattgtaaacagctggatgtgtttgggaatacactaaaaaaaatagttttgaatgatattttttatttgtcagtattcaactctcagagccagtatgtaggaaaatttcttggaatcagaatgacttcagagatatttcatcctttctaaatgataaataatttattatataattcatttgctacttcactccagctaaagactatgattgatcccatggaattgttctaagtaaggcaacatttcatatctctttcctgttcagaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatagtaagagaaattagctctgatctttgcccctaacatttccaatagagaaaagattgtgagtttaaaattttgtaaatgtacccatgttagtattcctgagattatgtgtgagaatgtaagataaataaaggaatgattggaactttgactagatccttttcctcacaatcaatctttcatgtacaatgtgtcaacatagggcttccagtctaaagtcattgcctaaggtgaaaaacatgaatagtcaaattcaccgttgaaaattttctatcaattatagtatatatatctctttaaatatatatatccaatataataatatacgtataaatgtgttttgtaaatagtagtgtatggtatataatcacatggttcggtaatttttaggaattgtttttatttttttgagatggagtctcgctctgttgcccaagctggagtgcagtggtgcagtcttggctcactgcaacctctgccccctgggttcaagggatcctcccacctcagccacctgagtaactgggattacaggcgtgcgccaccacacccagctaatttttgtatttttcgtagagatgggtttcaccatgttggccaggctggtctcaaattcctgacctcaagtgatccacccgcctgccttggcctccaaagtgctgggattataggcatgagccactgccccggcctcaggaattattttattgttttgttgcttggaacacttgaataagtatataaaaattctaccttgttgacattttattggttgaagtcatcttggacttttgtggacagtaatatgatgttcctctcatttataggtcactatttctctatgacccttaatttttttatctttctttttcatgtcatcactaactatcaacatctgctaactaaattgatgccttttattcctttgtggataatcttgggtttcacaggcatgcattgacaagttcaggcttgattacatccattgcctgcacacttaacacattttgagaggatcagtgaacagaattacttgtactgtttaaattcaagttctttttgagcatgattatagatggagtcttgaggttcaatgaatatttgatgcaaccaccgtgtatgtaatgtgctagtttccaaaaatgttttttgtttagcacctgtttttcagatagagcttataatatccagatgtgtaagcactatgtccagatttatatttaaggagataagaagcagctgtactactgtgaaaatcgtctttataaaaaaaaaaaattagctactctgtactaccagtaattctgtctacactgaatgtgttactaacgtttttctatctttttatctttagttggattgaatgaacaaatgaaggctgttcgaaagagaaatgagacctctgttatcgatcagattggggaagatttgctgacatgggtaaggaaattttctgtttctttttaatatttttatggacacttgatggttagattcaagttgagtaactaacctttccaaatatgcaaactcatccatgttgcaaagttaatgcaaagctgagaaaggtcaagcagtagattccatttcaagaaaccacctgttttgctcatctgtaagaagcagacccttatccattaaaagtcataccatgagattgcagtgattcagtcacaccttcaggctccactgtaatcctagtttttttgcagttacctcttccactgaagtcttgaacccctcgaagtcacctatgagggttggaatcaacttccaaactcctgttaatattgatattttgacctcctcctgtgaattatgaatgttcttaatggcatctagaataatgaatccttttcagaaggtattcagtttgctttgcccagaccaatcagaggaatcaccttatgaaatatatttcttaaataataagacttgaaagtgaaaattactccttggtccatgagctgcagaatggatattgtgttagcaggcctgcaaacaacattgatctccttgtacatctccatcagaagtctttaagtgaccatgtgcattgtcaatgggcagtaatattttaaaagtaactttttttttttctgagcagtaggtcttaacagacatgctgtcatctaggctttgttgtttcatttatagagcacagacagagtagatttagcattattcttaagggtcccaggaatttcagaatggtaaacaatcattggcttcaacttaaagtcattggcccctaacaagagagctggcctttcttttgacatgctgaagtcagacattgatttctcctctctagctatgaaagttctagatggcatcttcttccaatagaaggctatttcatctacattgaatatctgttgttcagtgtagccactgtaatcaattatctcaggtacgtcttctggataacttactatagcttctactgctatatcagcacttgctgcatcactttgtacttttatttttatggagatgacttcttttcttaaatctcatcagtttacccctgctaccttcaaactcttcgtctgcagcttccttacctctcagccttcatagaattgaagagaattaggggcttgctttgtattaggctttggcttaagggaatattgtggctgatttcatcttctttatacagactaataggctgtttcactttcctcttgttcatttgttcattggagtagcacttttatttccttcaagaattttttctttgtgttcacaagttggccatttggcgtaagagccaaatctcagcttttgacatgccttccttactaaacttaatcatttctagcttttaatttcaagtgagagatatgtgactcctcacttgaacccctaaagaccattgcagcattgttaattggcccaaattcaatattgttgtgtctcagaataaggaggcccaaggaaagggaagagagttgggggaatggtcagttggtggggcggtcagaacacacacaacatttttccattaggtttgccaccatatgtgggtgcagttcatggtgccccaaagcaataaatagtaacatcaaagatcactgatgacagatcaccgtaacagagtaaaatgaaacagcttaaactattatgagaactaccaaaatgtggcacagagacatgacatgagcacatggttttggaaaaacggcaccaacagacttgctcagggttgccatcaaccttcaatttgtaaaaaatggagtatctgcaaagtacaataaaaatgtgaggtatgcctgtacctgtaaaaagttgaggaaaagcagaatggtggtttgtaactgtcacatacaaagcgttaatttagaagaaggcattggccagaaatcataaaagcaaaaatcataaataggcctttagattttactcttgctgtttaaataaaatcattttggaaagtatttttccagtattgtttccttaagatcactttacatacacagacaatccttgacttactatggttccaacttcgacagtttttttactttacagtggtgggaaagtaatacacattcaatagaaaccatactttgaattttgaattttaatcttttccggagcttggcaatatgtggtatgttactcttgatgctgggcagcaacagtgagccacagctcctggtcagccatgtgatcacagggtaaacaaccactctacagtgtactgtactgctagatgattttgcccagctgtaggctaatgcaagtgttctgagcacatttaaggtcagctaggccaagctatggtatttggtaggttcagtgtattaaatgctttctcaacttaagatattttcaatttttgatggttttattaggatataagttcatcagaaatcaaggaacatctatacttaaactgcttgtaaaactactgtagaggccgggcgcagtggctcatgcctataatccctgcactttgggaggccgaggcaggcagatcacctgaggtcaggagtttaagaccagcttgaccaacatggagaaaccccatctctactaaaaatacaaaattagccaggcatggtagtgcatgtctgtaatcccagctactcgggaggctgaggcaggagaatcgcttgaacctgggaggtggaggttgcggtgagctgagatcgagccattgcactccagcctgggcaacaagagcgaaactcagtctcaaaaaaaaaaaaaaaaaaaaaccaaaaaaaactactgtagaactgcttgagtttgggggcattattttctttggtaaacccagctgctttttgtagttgtgtggtgctttgattgactaacatgctaaaaatgctgccagtctccttgttaaacatgttaaatgtcatattcatcatagagtaagaatacaaaattggagtgacctattaaaatattgctttgtatgtgtcctacttgaaaaaatactctgaatttatctacaaatgcgctacaggcgggctttttacaaaatgcctttatgtacaaacttttgggaatatggctttaaatggaagattatatggaaaacatcttcgtaaaccataaagcaattatctacaagtatagaggctgtattaaaaaacaatgtatttgacttctacgagcacctactagtaaatcactttttaggtgtttaaccatcagaaatcttaaaatcatggcacatgcaaacttaaatttacaaattaaaaaacattagtgagaagtataatttttagcaaaagaattcataagctcattgatctcccccaagccagctccagctgctgcacaggtgaaacagcagtgatttaattttgtttcaacacagaaaacttacggcctgcccatggtcatagtgggttttatactgagtaagaaggaatgctagtatgccaaggatttgcttcccagagtagtaagacagtagttgttgtaaaggcttcagggtgtaagaaaattaaattttaggccagatgtagtggctcatgcccataatcccagcactttgagaggccaaggcaggcggatcacttgatgtcaggagttcaagaccggcctggccaacatggtgaaaccccatctctactaaaaatacaaaaaaaattagccaggcgtggtggcacacgcctgtagtcccaactacttgggaggctgagacaggagaatcactggaacctgggaggcggaggttgcagtgagctgagattgcaccactatactccagcctgggccacagaatgagactgtctgaaaaaaaaaaaaatgaaaatttagtctcagtcttcaggcattttgtatcttatattctccaaatgtcagcttgtctgtgtaatttataagtaacgtaggctgaaaggtaataggttgtgataggctacaagcaagaaaacattgggactgggcacagtggctcacgcctgtaatcccagcactttggggacaccaaggtgggcagatcacctgaggtcaggagtttgagaacagcctggccaacatggtgaaaccccatctctactaaaaatacaaaaattagctgggtgtggtggtgtgtgcctgtagtcccagttacttgggaggcagaggtgagaatctcatgaacctcagaggcagaagttgcagtgagccaagatcatgccattgtactccagcctgggcgacagagcaacactgtctcaaaaaaaagaaaaaaaaaagaagaagaaaacattggaatatgatcagaaaaggtctggttgtgtcaagatcagacctttttaatggagaaccattgatattccacatagatatgcagttctgtgtattttgtcacttgaaatattgaaaggattctggttgtctgtcactttgtctggcttgtataagctcagtttcccattctcttttgtgttctttgcattcttggcacagttcagcggaccaggagaggagaaattgaaacatgctgctgctaccttttgcagtaaccaacctttcgccctggaaatgatcaaatctcgtcagaaaaaggattctcgatttcagacttttgtgcaagtgagttgagtgagtcatgtaagaaaaaaaataaggcaagtttttatcaattatcagataaactgggggaattctgactaagacttttacaaagattacatctgtgttaactttttttttttgagacagggtctcgctgtgttgcccaggctggagtgcaatggcacaatctcagctcactgcaacctctgcctcctgggttcaagcgattctcctgcctcagccttcctagtagttaggattacaggtacatgctaccacgccctgctaattttttctatttttagtagagacggggtttcaccatgttggccaggctgggctcgaacacctgacctcaagtgatctgcccacctcggcctcccgaagggattacaggtgtgagccactgcacctggcccacgttaacatttttaaaagcaatacattatctcttaaattcctggaaggtacaaaaatgactttggaatggtgaagaataataaaaaatatatgtcaggattaaaatacttaatatagaaatccacattgccacgaggcttttatcagtaaacaaccgtatgctctattaagagaatattgtcaaagcatgagaatgggtttatccagggaaaaacgtaacagcagccacactcattggggtatatgaattaagggttggtaaactatggccgacagaccatatctagtctgttacctgtttttataaagttttatgtaaatacaaacatggccgcttgacagatttctcacagttgttgtggtgtgtgggtatggtttagcaggttcctcccttgagagtttgaccaggctgagatcacagcgtcagcgggagctgcagttttcatctgatgctcgaggttctcttctaagctcactggttgttagcagagttcatttctttgtaaatgtataactgaggtcctaccttgctagctattggctaggaaccagtttcaactcctagagaacagagagatctctgccatatggccccattaggcagtttagaggtggatgtttgctttcttccaggccagtaggaatgtggctttctgacacagatttgttttaaaggctcctctaatgaaatcaggcccagccaggataatttcctttcttatgatctcaaaatcatgtggtggcaacctaatcataggtgtgatatcccattgtaatcacagattccaaaaatgttcatactcaagggcataggattacacagagtatttacacaagaggatgggaaccttggaggccatattagagttctttactacacagagccttgttcattcacttatgccaaaacagtagagctgaatagttgtgagagagactatatggcctgcaaagcctaaaatatttactatctggcattttactaaaaactttgcagaccactggtatagatgagctggcatactcgactggttatccattgtgcatacttggaatggcagataacaaattagctaaccaattttggtaggaatgtcaatcataggagaatggacctagattttctgaataggtgaagataaaactgtttcaacacaaggaagcgatacgtagagctgcttatggatgctttcagtccttccttaaacagataacaagccattcatttagtaatagaggctcccttcccccattatgtgattaaaggagaaagcagaagtatattgtggcaatgatatatcttggcattttttaaagatcttgatttaataaccagaactgtgatgcattaaaccctcacggtgaatacatggtacatgtataagttcaaataagaattacagattcacttatttcactttaattttaggatgctgaaagtaatccactgtgtcgtcgtcttcaactgaaggatattattcccactcaaatgcaaaggcttactaagtacccacttctgttggataatattgccaaatacacaggtacagcattttcactgaaataaaaagcttaagaacaacaacaacgaaacacccaatatcctgtaaataatatcttacagcgtcctgaatggagttggatttccaaatagtatgacaagattttctttttttttttttttttttccttttttgagacagggtctcactcagtcttgcaggctggagtgcagtggcacaatcatagtttcctgcaacctcaaactcctcggctcaggcattccttccacctcagcttcccgaacagctgggactacaggggtacaccaccacacttggctttttttttttttttttttagcaagggtctcactatgttgctcaggctggtctcaaactcctggcctcaagcagtcctcctgcctcccagagtgctgtgattataggcatgagtcaccatacccagccaagattttctaacaagatatgatctagtcttcttcgggctgtttgatataatgtactccattagtagctttagtacggggtatatcaaactatgaatcatagaccaagtcatgctcactgtctgtttttgtaaataaagttttattggagcacagccgtgctcgtctgtttatgtactgtccctgattgcttttacattataacagcagagtcgagtagttttatcggtgcccatttggcctacaaagtgtaaaattatctggttcaaccatccttgttctagcctgcatcatttttgctttgaagaaggttcatccttggctgaagagatgtttcatggatatctatcaatgacttttattaagccaaatcaatgcggtgtaattccaactctcccgttttgaaacatgaaatgaatctgtttctcagctgagctttaggttcttatacttagctctcattaataatttaatgcaactgaaatcttgtttcttgtgcctgagaatttgaatgcataagcaggaaattttaaattatggtacctggtaacaaaagtggtttacactcatacatattaatttttacactttaatatatctgctcagtgtagttagactgtggtttggaggattataattttgaatgttctgattttggtcttctttgtattatagacatgacatagcctcaatacgttttgtcttgttttgttttgttttgttttgtttttttgagacggagtctcgctctgtcgcccaggctggagtgaagtggcacaatctctgctcactgcaacctccacctcccgggttcaagcaattcccctgcctcagcctcccgagtagctgggattacaggcgcacgccaccacacctggctaatttttttgtatttttagtagaaacaaggtttcaccatattggccagactggtcttgaactcctgacctcaggcagtccgcctgccttggcctcccaaagtgctaggattacaggcatgagccaccttgccttgccgcctcaatacgttttgatgaatttcatcttcttttaatgtaatctattttctttctttaaatataatctcaaattcaaagaaacttgttttggaattattttgaattgtgttattaaaaaattttgtttaacaagttcactggacataattatgtaggctatgcactgtgaaattctgaggggagaagggatttccatttatattatttacaaagtaaatgagacctgcccttctggagtgtatagtatagtggtcctggtacttcacgtaaagcatctcttcttggatttcgggttctgtactgtgatttctttttaaagattagaatttatgttttaaagtcctgttataagaagttttacctgtccaaagactgcttgaattgagactctgacagaggctttaagctggtacaaaaatcttcaaggtcttaatatgctcttaaaagtattgaaatgaaatgaaatctcatttacatatattttatggttttttgctcagttcttttacattttggatttctttcccatatttagaatggccaacagaaagggagaaggtgaagaaagctgcagatcactgtcgtcagatcttaaattatgtaaatcaggctgtcaaggaggcagaaaacaagcaggtaaaaaaggaaaacaagaaggtacaggatgacattgggagaacattaaattaatattacctggaatctgtgaaatagttgttaaaactatcattacctaatggacagggagaacatttgtttactgttcgcatagtaggcaggtcaagatcaatctgtgatagaatatcggagttgtatttgactttttgaaacacctcaagctgcttgtttgctctttcatttatctcttcattcagcagatatttatagaacatctactgtatgctgggcatagggtacagagtagttgagaaaatgagtgcaatatctgcccacactgagcttgtttgctaggaggatagaaaggcatttaacaggattatagtgcaaatattttgtatcagttgtgatagctactatcaaggataatttcaagatgctacgatatataactatggggcctagcttagtttggggatgttaggtggtgcctattagagaaaattttcttgaggaattgacacttgagccaagctctgaaggatgagtggaagtgaaccaaaatgatgtgaagggtgcaaccctagaggtagaggcaatatataccaaagtcctgacggaaaaagaaagcatggtctgttggaagaattgaaaatttacatgagtgtggatcatgcctaaaaagcaaagtcagagtggcataaaatgaggtaaagtagaccaaggccaactcataaaggccctagagatcaggttaaagattttgatttgtcttcttaagtgcagtaggaattcagcatagacaagtaagaatatagtgttcagattttcattatctgaactagtactctatggagaatgagttgaagaagggtggtggatgaaagagcccatttattaacctcttgcagcaatctaggatagatgatggcagcttagagaagttggagaagtatttagaaggtaaaattgacaggacttgatgactgatttgaagaaggatttgaaggaaaagtgatgtcaagaataaacccccaggtttctggattgcatatttggatggacaggatgagtggagaagccccacgtttgtggggaagatgatgaggtcactctgggatatcaggtagacatgcacagtaagcagttggctgtatgggcccacctctaagaggaccatgttgaagataaaaattcaagattgtgagcatacaggggctgattgaatccgtgaacacggatgtagtttcttaggagctgagtatgattacaactctcttggtgaggctgtagaaaaactagtactttcagctgtgctgttcagagtgtaaaatgataaaaccccagagggttatgtagcaatatttatctaaattaaaactctgtaggtacccttatatctaccttttgactccgcagttctgttcctagtgatttgctcaagagaaatgaaccatattagagttctttactacacagagcctgttcatttatgtattatctgtggctacttttgttccaaaacagtggagctgaacaactgggagagagattatatggcctgcaaagcctaactgacattttactaaaaaccttgcagacccctggtatagatgagctggcatactcaggctggttatccattgtgcctgccgggaatggcacataacaaattaactaactaactttagtaggaacaccaatcataagcaaatggacctagattttctgaataataaaatatatctttatctgaagataaagatatacccacaaacagacttagaccagaatgcttatagcaactttattcataatagcgaaaagctagaaacagcccaagaatttatcaacagaatggataaaccaactgtggtatagttataaaatagaatgccctgagtgataggaaaggaatgtaccactaaggcacacaacatggatgaatctcacaaacatgctgagtggaaaaaaaacagatgcaaaagagtacatacctatgattccatttatatgaacttctaagagagaccaaactattctatggtaggaaaaaccagaaaactggttcccattggggatgaggaggtagaaattaactgggaagaagtatgaggaaactttctggggtgatggtaaaattttctatcatgatagaagtttaggttacacaaatgtgtaagcacttgtcaaaattcatggaacatacacttgaaatgtgtgttctactgtatgcaaattttacttttttaaaaagaactgtatggatgtttaaatgtttagaggtaaagtgtacttatgtctgtaatttattttgaaatgcatccaaaaaataagatggactgatggatagagggatgaataaatagatatatgataaaacaaatagagcaaatgttaattgtagaatatagatggtaatatataggtgttcactatgctcactcagacttttccatgtatttggaaatgatattgtgggggaatgtacataccctttgatccaacagttctggaaatttatcctacagatatcctacatggatgtacaaagacatatatttaagtccactttattacagtattgtttgttacagaagagttgaagtaacttaaatgcccatcagtaaggcgtaatgaaataaattatagtttattcagagagttttacatcctgtagtcatttataaaaaaatgaaataactctctatatgtgctaatgtggaacagtccccaagatataagtcatacaccacacacacacacacgtgggggaatacgtatatgaatgtattctaccatttcaatgaggaatacatataggaataccaaaggaatgcatatatgaatatattatgctaccatatcttgttttaaaaaaggacatatacacacaacatgcacaaagacaagcatacttatatatacatatataaataaatacatatctgtttgcatagaatttttctcaaaggctacccaagaaatggatattagtgattgcttctttagggaaaattgaggggggtggggcaataggacaaggttagagggagactttttattttttgccttatatagccatctgaattttgtactgtgtgcatgatttacatattcagaaaataaatataagctaataagagaccaatgactttgaaaagaagattgagaaagaaaagccaaagaggcaggaggaaaactaggagagtatattatcaccaaagccacgggaagagagtgagttttcagtcctgtctagcattgcaaagagctcagtaaaatggagattttttttttttgagatggagtcttgctgtgtcgcccaggctggagtgcagtggcgtgatctcggctcactgcaagctccgcctcccaggtttgcaccattcccctgcctcagcctcccaagtagctgggaccacaggcgcccgccaccatgcccggctaatttttttttatttttagtagagacggggtttcactgtgttagccaggatggtcttgatctcctaacctcgtgatccacctgcctcagcctcccaaagtgctgagattacaggtgtgagccaccacgcctggccaaaatggagattttaaatgccaagtttgattcagaaatagagaggtcattaatgaccaaagcactaaccttggttccaccctgcctaattttcagcgcctagaagattatcagcgtcgccttgatacctccagcctgaagttgtcagagtacccaaatgttgaagagctcagggtgagagatggtctaatcataatttaaaaaataaaataaaatttgctaaagacctggcaggtaattaacatctcagtgggaatatacgtcacctgaaggagttcttgtatcgtagattatctgtatttatgattttttttgctgccttttaaatgcttgatctgtatgaaattagtttttcattagaggaatatcttgcataaaactgtaatattacatgacagcaattggcaggagactaagggacactaattattataaaatttaattttattgtgttctgtagtttgtttcagacagggtcttgctctgttgcccaggctggaatgcagtggtgcagtcttggctcactgaagccttggcctcctggactcaggcagtccacccacctcagcctccctagcagctaggactataggtatatgccaccatacccagctaattctgtgttttgtaaagacaaggtctcgctgtgttgtcaggttggtccagatttcctgggctcaagtgctcctttctcagcctcccacagtgcagggattacaggcatgagccactatgcccagcctgtgttctgtagtttaaataagggtaggactgtttggtaactttccagatcatttaataacacaagatagcatactattttctcatgaggctcttcagaagcataaaagttggaaccattacaggaacgatagtaaaatgtttactaattgccacttctagtatgtgggcttatgtgttaactttttcggattttaagtgtttttgtaccatttcactaggtggtggttttggcagatttatttggtggctgttaaaatagacttttatgtcatatattaatacttcgtcaacaagcacgtaaatgtgcttattccccttagcttccaaagaatgagagttttctagagctgctaatactaaaagatgattctcttactaataagttgttaatatttagaccaagtctgagtagtacctggacttttcatgagtactatttcttagaactttctttgaaattagagccttggaactcagaagccactttcttatagacaagcatatgtaccatgctcatccagttattcataggaaaattaaaggatacgttgagaatctagtgactgaatgtttgtaacttgatcttcataatctgttatcatctgtttagagtgaggtttgaagatagtactcctgaatgttcttctgcaagataccttttcctttttagaaaattgtatgcagattactttaatatggcttttgtgccattttcaagaactgacaaatagcaataatgatagttgaatgtaaatggtgtattttatattaagaatttctttaaaagagactgtattatatagataatcatgttactgagtgcttggaaattatttgtgcatgattttctttattttgccagaatttggatttaacaaaaaggaagatgattcatgaagggccattggtttggaaggtgaatagagataaaactattggtaggtctgatattgtcttttagttttggggagagtggcaaaagggaaggaataggaaagtttcctatgacaaagggaagaggagagaaccattctctcagcagtttgcagtgctacctcgtgttatttgtacatttgtagatctgcttgtgttatttcattatatgtaagatgtgttaaatattcatttaggaatgtagtggagaactgatttagtcctatttccatcattcttatagtctagtgagtctttgtatgctttgtaagctttctttagaccagtacatcttaaactgtctgtgatgaggaaccgtttttgttttttcagaaacaaggtctttctatgttgcccaggctggagcacagtggctagtcacagatgcagtcatggtgcactgctgcctcgaactcctgggcttaagggatcctcctgccttagcctccctagtagccgggactataggcgcacagcaccacacccagcttgttgttttttatttcctattggtcacagactgacacttcagtgaaataaaataaaaatgaattactgaaaatgaaattttaaaagataatatacaagtcaatttttaaaattttgtagctttaacagaaatagaattcctctgttgaatcattataaagttaatcaaacgcgtctccatttctgtacttaccatttttttctgcacttttatttctagatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacaggcaagtatgtccactgaaggatactaatttccagattcattgtgaagttgcataagatactcggtgctgtctcaataacacaagtggcatagagtcttgctatttttatattcttaagcaaattacatgaaatttactgcttagaaagagacctaagagtttataccccaaagttattagggtgtctcgattctgtgaacagttttctgcatttgaaaatttttatgctattactttggttctttatgttcaaatcattgatagatcccaatgaaaagcctttcatttagggtggtatgttttttgatttggtgagaaaaaaatcaaaaaccaaagagacggatgtagtgttgattaaaaatcaaatttgactggcaagttatattttaactctattaacaacggggtcccttttaaaacttgttagtttcatggtggcaaaataaatttgtgacctcttttctccactactcactgaatattattaactaacaacttagcaaaagtgcagttcaaaataaatgcaaaagagtaatagcatttaatctggtaatttggatttatttattttttttcttttgagacgagggtcccaccctgtcacccaggctggagtgcagtggtacaaccttggcacactgcaacctccacatcccaggctcaagcaattcttcaacctcagcctcctgagtagctgggactacaggcatgcaccaccatgacctggctaatttttttgttttatgtagaggcagggtttcgccatgctgcccaggctggtctcgaactcctgagctccaagcggtccacctgcctcggcctcctaaagtactgggattacaggtgtgagccaccgtgcccggccagtaatttggatttttgacatgcttttagcaaagtttctagtaaattattgtggaattagtgctaattcgtataatctttgttttattgaagtacaataaatatagtacaataaatacgttaatatggtaagttgcacaaattttaagtgtacatcttgatgaattttaaagtaaatatatgtaacctttatctagtttaaggggcagactatttcaagaccctaaaaacatccctcatggcctccccaggtcatagtattagagtaatcttgtattgttttttccagataacaaagctttattcgtcatttccatgtcagacaatggcgctcagatttatgaactggtggcacagacagtttctgaaaagactgtgtatgtatcagatatggctaccttgctatagctaatattttcattatcccaagcgtaatattccataaacttaactttgtttttataatgtatggaaaccaagcacttcctctgtactcttttagagacgttctactatgaacttgttcttttttaggttgatgccttttattttgattctattctgaaagtttatttcctaaagaaaaaattgtgcaaaatgtcaagtgaagtttttttaatgtgtccatagatttctcttaaggtatagttttggactctcgccttaatagtgtgttgccaaaataaagatattctctggcagagtgggttttgttgttgttgttgttgttgttgttgttgttgttgttggttgatttggtttttgtttagttttgctttctgagtatatttaaaggatatttcttttttcttttttgtattttggatttctttccaactttctgaagctggcaggacctaatctgtcggatggctgcatcagtgaaggagcaatccacaaagccaattccattaccacagtcaacacctggcgagtgagtgttcctttgcattgtagtaggacttattttatgttttgggttggaaaagactaggataattattatgttttgttgcgatgatgtttagatacctcaggaaggtaaaagtttttttttttttttttttctctacagaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagataggcgtatcacctgaggccaggagttagaggccaacctgaccaacatgacaaaaccctgtctctactaaaaaatacaaaaattagccgggcatggtggtaggtgcctgtaatcccagctacttgggaggctgaggcagggagaattgcttgaacccaggaggcggaggttacggtgagccgagatcgtgccattgcactccagcctgggcaacaagaccgaaacaccaaaaaaaaaaaagaaaaaaagaaaaaaaagaaaataaaataaaatgcaaagaaactttaatactgtttggtttatgcaggttccagcatcagagattcagtttaacaaactttgcctttgagccttctgtgtgtcagtataacactgttctaagtgatgtgtatttttcttaacagatgatctctgtagtttatggattgttttttttttttctgattcttccctgaatgcttcatgttaaaagttaaaagctttgtttagatatagtctaccttttctattccattggacagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaattgtaagttttattcataacttattacagatacttactaagtatgacactcatgtgccatccctaaagtatgtggatttatcaaactccacttattcttctagttctattgtggagattatagtattctctacagtggcccatgccacaggcacacacacacatgccactctgttagctccccacccccctgcctggttcagaatcactgttaaaatgggaggatagcatatctctcagttgtattgaggtgggaaaaaggctgagaacaatttctttggctggggagaaccacttgaaatttttaaaccagcgtatgactaaaggtatgaaaaaagattaatctggctgaaagcggtggaaggatttgaatggaaagaggtatggaatggtgtacttactaaataagctattataatagtctggcctgagactaaaagagtttggactagaatgttatcagaaggaataagaagaaactgagaagtcatcaaatgcttaaaataattgacttctttgaatgtgaggtcaaaggaaagggaatatttagagataatttcattaatctagtcagaaataagagtcagaaaaggactaccactgcttcccccacctccttccattgtactttcttttttctttcttttgatttggtagaattataggctcagttttaaagcatgtcaagattaagataatgaatgacaaaacactaaaaagtgagtaactagcaggaagttagagttttaggagtgaaactttagagagaggttaggaagagatagagatgtgagcatcagagccatgagacttcctggcatctctcaggaagtgattgtagagcagaaggacagaggatgagagacctaagtggaacctgttgcctaaagaaacatgacagacattaagctagtgatgagagcagagaattggttatttaaaacctacaatattttttataccttctcctgaattaacagtcttaataatttctgatggttggaataacattgtcccaataactctatcattgtctgggtgacctcatagcatacacttggcccattcaaaattaaattggttcttattttcagtaaatgtatgtatctcataaaattagaggaaataatatgcatatagtgtctggatctggaaaaagcagaacttttttttagctttttctgtctagcttaacacagcctttcaacattcttaagaagtacctttagggtattattctagttatatagaagaaaaaatagaggcatgatattggttattgaggagttctaaatagtagtatctccctattcagaatgcttagatcttttcaagtttagtttaacgttaaatcttctctaaaagatggtgctttatttcatcttcaaaacaaaatggaaaatgattgtatgaagtaagatgattgtatgaaattaataattaacattttaatatgtcattaaaagatactttttaaagatagatcattggtaagtcagctaatttaattcttgcagcctgaggttatagttgtgaatatgttttttttccccctccttcctaaatcgtttagtgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggcaagtatctttcacacttaaactttgattttgattttgatcattgttaactgtcctgtattttgaaatggatgttgtattggtatccaggtgtgtgtgtgtgtgtgtgttcacacatgtgcaatatttattccttcatttgataaatactgaatctactctgtaccagacctcatcataggtgctgggagatatagcagtgaataaaacacagaaaaatcccatcttctcatgaagctaggggaaagaaggatggtaaataagtaaacaaataaatagacttcaggaagtattaggaagaaacataagtcagactgaggggacggagagtaatgaaggcaaacagggtgatcagggattaggacctccgatgaggtagcatttgagcagagacctcaatgaaatgagggaataaagccgggtgggtacctgggagcttactattccagcagagagcagagtggggcagaggctttgtgtcaaagagcaagctttttgtggtgatcgaacactggatgagggagacaatggcaggagatggggcaagagaggcgtttggcaggggaagtggtagcaagatcatttaggcactgtagtttccagctttaaacttttgaaatgaaattttttggaaattaccatgaaagtttgcagagtttagctttcatctgaagtgaggaaattctgatgtacctgaaactaaactcaggaattaatggcttttccctctcttaataacttttcaagttgaagttgtcagcacactatgctatttctgttttctaatggcagcactggtcttatcaaactattctgtctctatccataggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaaggtacctcatacttccacatccataggacttggttgtaagaaacatttagcagaggggaagaatagggtgatgaaaatgctgatgtcaataaacttgttcaggttctagatttctttgactattatccatgaataggcctgggtaaaaagttgagattggcattgtttatctttttctttctttctttttttttttttttttgagacggagtctcgctctgtcaaccaggctagagtgcagtggcgtgatctcagctcactgcaagctctgccttccaggttcacaccattctcctgcctcagcctcccaagcagctgggactacaggcacccgcccccacgcccagctaattttttgtatttttaatagagacggggtttcaccatgttagccaggatggtctcgatctcctgacctcgtgatccgcctgcctcggcctcccaaagtactgggattacaggcgtgagccaccgcgcccagtcggcattgtttatcttttgactatcacaagagcagaaaaagttgcagctctgtgaactgtgtgtttgtatgggtgtctaagtttaagaacctgaaatgcttcgggtagttggctggcctctgtcagacatgaacaagaagatgagataggtagggtttatgtagttatgaatctaggctgagaaatgctatgactttctgtagcctattatctgtgactcattaggtgacattggcagcttcccaaatcctatgacagatagaaattggcttcagtggctcctgtaatctaaaaacatggtcatgcatgggatttttgtagattggtaattgaagatgtcactattgcaaaactgacttgtgtggcaatttccaagagaaagacctatcttaaagttttccatcagaggcagggcacggtggctcacgcctgtaattccagcactttgggaggcaaggcaggcggatcacgaggtcaggagatcgagaccatccttgctaacacggtgaaaccccgtctctactaaaaataaaaaaaatcagccaggtgtggtggtgggcgcctgtagtcccagctactcaggaggctgaggcaggagaatggcatgaacctgggaggcggagcttgcagggagctgagatcacgccactgcactccaacctgggtgacagagcgagactctgtctcaaaaaaaaaaaaaaaagtttgccatcagaaaacacagcttccagagcccaaacattttcctcatgacatcatttacaccagagacttgaggggtagatttaagtatccttagcctttgagttaaagactggtctcccttagtttctcttttaccttcatataattgatttttccctcttcatgttacttattttatgtagtatcattctgtagctgatgagatatcgacaagcccattgaggacaggtcggttcttatatacagtcatgtgttgcttagcaatggggatatattctgagaaattcatcattaggcatttttatctttgtgtgaacttcacagagtgtacttacacaaacctagatagaatatatctttatttacatagattttttcatatggaaagccaaatctctcaacactattactgaatattagtcatttcccctacctgatcagcaatgccattattaagtgccacacaccaggtttctacatgtgctccataataatcttttttttttttttttttttttgagacagtcttgctctgtcacccaggctggagtgcagtggcgctatttcggctcactgcaacctctgcctcccaggttcaagcgattctcctgccttggcctcccaaggagctgggactacaggcaccaccaccatgcccagataaatttttttttttttttaaatggagtctcggtctgtcacccaggctggagtgcaatggtgcaatctcggctcaccgcaacctccgcctcccgggttcaagcgattctcctgcctcagcttcctgagtagctgggattacaggtgcccgccaccacacccagctaatttttttctatcttttaatttatttatgtatttatattttttgagacagagtcttgctctgtcgcccaggctggagtgcagtggcatgatctctcctcactgcaagctccacctcccaggttcacgccattctcctgcctcagcctccccagtagctgggactacaggcgcctgccaccatgcccggctaattttttttatttttagtagagacggggtttcaccatgttagcctggatggtctcgatctcctgacctcgtgatccgcctgcctcggcctcccaaagtgttgggattacaggcgtgagccaccgcgcccagtcccagctaatttttataattttagtagagacaggatttcaccatgttggccaggctggtctggaactcctgacctcaggtgatccacctgcctcggcctcccaaagtgctgggattacaggcgtgagccaccatgccccacccataataatcttaagggaccatcatcatgtatgcaggccgccatgtctttatgtgctgcatgactatagctcatgcacatgatgacgggaccatgtccagggtgactcctgggggtgggagaattgcatctatggttaccacctctactttctttttacatgggaaaatactaagttattccttcagtggagaaattggtaaaaggaatgaaatttacttttttcttcccactaatgaaatttttaatgatgaagttaatatttttgaaatttgggggcttgtacctgtaatgtaaaaagggcttcttttctgttttctgaagtttttgttttgttttgtttcattacgtttgaataaaaaacctatgggttttatttcacagaaggtggaggaaagttacaccattctttgccaaaggctggctggatcagccctcacagacaagcactcaggtatgtaaaagttatgagttccagactctagactaatcatcctacactgaatgaaatgacttatcatactttgaagtgaaaaccttctgagattccatttctcttctgtctttaaagaactgcctgtttctaaacatcagatatcaagcggaagctcatgcctgctgactctactcttctctaagaggaactgcagttgtcagttcccataccatcccctcttctctctcttttcaccttttcaaagcagaaggcagagcagtgggaagcctggtaaatcacagattcggtgtgaggcttactggtactgctgtgactccctagtgtggaggatttggccttattggatgttggtgcacttgcctctgctgacagtgtggctggtgtctcccctgactgcagatggatttgtgttccctgcagcagtttatactcatctgcttacatactgattcagaaacaaagattgaaccacgcccacagatgtcatgggtattctttgcaatgttagtatattctttttcttaatatcatttccatgtatctttattcttctcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 4 - DNA, 153525 bp, Homo sapiens
  source 1..153525: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggttggtatgaattcctccttcgttcggcctcccggaatcgggcccgacctagcaggggagtcggtgattgcagattgcctttggccagcgaagttgacaggcagaggaaagagggttgtttcggagctgtgcagttagcctggggttgctgccgagttatccagttgattggcttttggaaatgtaatttttccggagagaaacttcccttccgattctcagagaagggggaggcaaaaccatgattgtggttttccgcctgtagtgtgcattaggattgtgtactcgtctggaaatcagaggagaaggtcattttaggtgaaggtcggtgcctgaagtcggctcggtattggtgtattatttatcagctttagccgtgtcctgcagtagattctcaagacaattacattttaggaatttctacctgtgaacttaatgttgagcctactgcatggtgatctgggaacttgatctctttcagatgttgacctgcacggtgtttaattattatctaataactttccagaatgttgacattaccagtaaatcacaggttcttgctggaagcaatgtccaggagctgaagaaatgagggtaaatcatggggtttgcttttaattcttgtatttaaatatttcgtcttccagaaacacttggcgtttaagagatataagccgtaagcatagtgtaagcgcgcagctgaatttgttgagttctgtgtctgtcctttatagcacctaccagtgttgcatggtggtgggtggcgaattgagctagaccatgtgtggttgaagtgcagtttgcttatcctaagttactcttgtttatagggtaagggataaaaagcatattgattccttgaccacatttcattctcaatttaattatgacactgcatgctagtcccaaatttgtcagcttgctttatttttaagtcagtcttcgaattattacaccgtgaaaaaatagatcaagtaactgaattagagggccaaagctctttgatgaaaagtgcaacaatagtgcttctgcacaaagtagtcttaatttcctaataagagttttacccaattgtaagactcatttgttgattttaaaagggccaaattccattatcataccataacagctactccagaaacagaacttcctcttcctgttgatgctttccagcatcacatgaatgttcacttaaaagagtctgttaaatatttaaagtatttatatttactctttgtgtatttttcaaagtgggttttcattttcaatgaaataatttttaacttttccaagaatacacttaagataagtattgacaatgcttatcttactttcttctggttatccccatttttttcctttcagggtgttttgcttctgagaaatcacttttacgggtgtggggataattgttttcctgcttcattcaattctcgctctttctgttgagcctgtaaacaaaagtcttgctaggaactaatgtaatgttggttttcattgcgatgctgaggtgtttaatttatggaaacagaacggactcattccacacacaagtgagtgaaaagccctcaagtaatggtttttcttcagcattgcttctcagggattttccttgtcttctcgttatcttggaaatagaatcttggaatttgtatcctctttataacgtagatggcatataaacattcaataaatatgaaattactgaaagcctgtttcttttctttttcttttttttttttttttttggccaggcactgtgcaggcacaagagattacaaaatgaatattgtaagattaatctgcaaattggtttgggcattaatgttttttgaactggttcaggtgctgctgcctaattttacattttttttttttaaagaaaagaccttggaaagccaattaataagcactgctgagacctgtttcgtaggatttttttttactagggtctttttttattaagaattattcttatttgaccacatttaaatatattttgtaaatataaagcatccatttgctgttaagagagtagttgttcctaatatgaatatatgttggggtgaaatctggaggtactggtttagtattatttctctgccaaggtgtcttaacaaagttacgagtatataatagtttctagctttctgtcagccctacctcatccttttttcgtagtgtctaactcttactgtaggtatattttgctgactctagaactgttggaaaattaacagcaccagtgtagctttttagatagagatcctttcaagtttgaagtgctgtatgtggtatggctttgtttcgtagagtgtgcagaaccaccaggccagctgtgtgagttagagttctttcattgtggtgcttctgactacagagtctgtctgtcctcagttgaaatcagactagctggttttgggcgttgttctgttttgcagtttgtggcaggcgacacatggctgaacaagataagggttttattcttgtgttagggacgtgctggggctgggatggaattcagctatgtttaggctctgattggtcactttggatactcagaactctgttacatcctgttattattttgcagttaaatcaacacattaacttgctctcttctctttcccttcatcttttactccccagtccgcaccccttaaaacctaaaactcaaactttttaaaagactttaaactcaaactatgttcatggtagctattacttctatgtagtatatccaaacagctttaaaaaaaatggtaagcaatttatgagccctggagtctgtagttttcatcgtttagaatgagcacttgacaagtgtagaaatgtctgattgctgctttttagtctgcattgattgctgcattcagtcttaaaatacatcctaatcgtttccaatcctcctacatgtctttcttgtatccctgagaatttaggggtcctatagcaattggaatttcttctgagaggtagacaggagagaatgcccttttagtagactcagtaaatgatttcaggccagtgtctataacattgaattttcagggacagtacaggtaggaaagttatagggttcttccttgaaataaatggacttttgttttggctagggcttatgaattttgtagtttttgatttatagataaagacaggtttttgatacaatttttttaaagcactgaattcagctttgagctgtttaacttaagcagatttttaaagtgagtgtggaaacctgtgactttatatgcctgtacccagtaattaatgatacttttcattagtgatactttttctgtcaaaattgctgtataatggttttgattaaaaaaaaaagagctactcatgtttatatgttattttcaacgttgcatgagtcatctctcggcaaggtgaaattatttgtaaccttttcttgtaaagtcagccagtccataaatacaaaattgaaatgggggccaaagatcacagtgttagttttgtattcagttttatctttgcctttttagttcagtataaaatcttgagtcataaaggtatgcaatagtacattcacttgtacagttttacatgagtcaacatgcagaatctaaagtaactttttttgaaagtacagtgttgtagtcttcctgattaatggtacatttatatgatgttcatattcagtaaggtgacaagagaagctttatttgaaatcattacaaaaatatgttaaccttggaataccacttaacacattggtggtttccggttgttaacatgtatataccatcgagttaacatgtaggtttttttcttttttgagtcttgctctgtcacccacggtggagtgcagtggcgtgatcccctcactgcaacctccgcctcccaggttcaagcggttctcctgcctcagcctcctgagtagctgggattacaggcacccaccaccacgcctggctaatttttgtatttttagtagagacggggtttcaccatattggccaggctggtcttgaactcctgaccttaggtgatccacccgtctcggcctcccaaagtgccgggattacaggcttgagccaccgagcccagtggttttttttgttgttgctgttgttgttttttaactaagtttgagttttcagtttaaaaaatgaaatttgaggcaaacattcatggaatccataaatggtgaattttacatatgtttctgtggagcattgcgattccagggaaaacagttggaaaatatttcattgtacatatgtggttgcctcttctaaatgtcatccagtggtgggtatgaattgcttcccaaactgatacgggtcacagaaacagcaagataacatactggttcccagaggtaattgaagggactcttttgcatcatggttgtctgacattattagaaatgtttcttatatacttgcttgtttcctagaaattgaccatgacacattttcaagaatagtagcttaacttcttttggtcttttctgttaaaacttggttttgatgatgttcctgagctttatttgaagacatgctcctttcccttataataattacaggttttcaaaatagtgccatgtgagttaaaatttttaaatcaacaaaattatatttttgccttcttttgagtaaaataccatcatgtaggtaatgatatcctgtggtagtataattctttaacatttacaatattttcagttcagtacagggcagatcatgcttctgtcatttacactttaagctaattcatacagtttaagtcaagattttaagtcaagattataaaactagaaagggcagacccaagattttaacctagattttctggctctcaagtcccccattgttttttttcattttaaattattgtctttctttgtactgtatttttctgtgctattttcctttagtaactctccagcttgatgaagtcagttggatttttctcttacagcatagtttctagtaccttacccattctaattttaaatatctcttgaggataaagcttttgtcacttcctcaggagactgaagcacagtctgatagatcttgctgtcaggaagtttttcctgatctttacgtctaacttttcttttaagttgtcctgttacttgtatgtacttgctgtaccaggctaaataatgctctcctcccattttatgtttgtatgattctaaatgtttcagacggttattcattatcctttccggtccccttcccttactctttgcttagccaagctgtatgctttctgttgatccattgtctaaaaatcagcttatcttaatatttcattagctttttctcagttgctctcctactgcaaaaatatgggtaaagagattctcaaggtcattttgattcacttttattttagatagtctttaggatggatatgagatatgtcacagtcaaatgaaacaaatttatacaaacagcatgattaccaaatcaactaattaagcaattactcatgttctaaaaggcttttttacaaagcgattctttcaaatatgagtaccctcaatgtaacaaatgttatcaattctatgacaaaagggtagggtatagaaataatgttagccacctttgatggaaaatcatcttgttgcaatatgatgaaatacatcaggaagttgtttcttattttttccagtggtttttcagttcgttatcttaaattgtaggtcaaaacattcctcgatgtttggtttatttttaccttattgttttgtctcctcttatttccacatgttagtgaaataacaatgcttagcagtattttttttttcagtaaaatggatattgtgaaaattgaaatattttactttcttgctgttgtatttacaagaattgttaatgacaagacagtgtaacagaaaaagtgcatatttagattattataaaatctgtaagactgtagaccttttgaatactttattagcatattttctttagtactattttagtttcaaattattgagatagatgtccttgttttgtattttgctaatattaatattttgtattttggtaatactaaaatttgcaaacatgccaaatttagagcattttactttttcaacttagaatatctggaatcatcaagatagtcatatagggaagaccgctataagacagcttctaactccaatagaagcctatgaagctagtgcctggtcagaggctgtgcctaaattgcatgagtatatagtgtcgacttttagtaaaagaaaaaatacactaactttacctcttgaattagcatgcaccaatgcagtttagattcataccgaaacaggatcttttactaattcaaatgctgagtcctggtttttgagatcacagtcacatgacaggcctgggtggcttctcagtgtctagagacaagcaaatctactggccaatgaaaagtaggtttcctgtcttggactgcaagtaacaattcatgcagaaattggaactatataagagagcctggttttagttaatgctttcaattagctgcttgtcacactgctttttcttttggtgttatataacacattagagtcatttaaaggtacactctgatactacagtttttgtcaaatattacatataaatgttgattttacattcatatactcaaaagatcaaagaggactttgtagatcttttatggattcaaaaaaatgtagattattttgttgtagaaaaactggccaggcgcggtggctcatgcctgtaaatcccagcactttggaaggctgaggtgggcggatcacttgaggtcaagagttcaagactagcctggtcagcatggtgaaaccctgtctctattaaaaatacaaaaatgagccggaccaggtggcacatgcctgtaatcccagctactcgggaggctaagacaggagaatcacttgaacccgggaggcggaggttgcagttagccaagattgcaccactgcactcctacctggatgacagagcaagactccgtctcaaaaaaaaaaaaaaaaaaaaaaaaaaaaactggagacttcatcagcctctgaaggaatgatacctgaaattgatcttgtaatgcagaaagtggctatatgttatccagaagagtaacagataccccaaatacacttgctaacacaagaaatcctgtgaaggtgcttagacatacccttccatagattttagatgggttatctgcctatgttccagacacaagccgatatgttgtggtttgcccagtacagtctctgtggtttactgagaggaagtggttcttgtgggtgaaggtctgatcttttcagagattgttggtggcatatgcactgtcagcctatttcctgttttattggctgtttagcaagaccttcttagggcaagtgctgctgaagaggtatttaaatattttgtattggcaggatagatggttataatgatgtattattatatcactacttctcaggtgatatgagagttaaatgaatgtttgtgaagtgctttgagatcttaggatgaaaagtacagacatgttcttagtcatttgcaggttactgctatgttcagatattgctctcttgaagttaaaacttgttcatgtagtaaagtgttactctattaaacttgatttctgtaaccattcaagtgttgttttatcaccacaagagtcatgattagaatttttcccctttttttcctttctttcaatgctcctttatgattttaccctagaagagtttccttaatagattccttgctctagtactggttaaggcatatttaccaaacttaacacctagcaagcttgtccaacctgccttattttgctgttgttcttctgttttgttttgttttaggctttcagcagcctgaagccatggtttttagtttctgtctctagtgataaaacggaaagagggatgaggaaggggctttactggcccatccagaaacagaaactaagaacccatgactgtattctctcccttgaacaactgtaactagagcaaacctctttgccaatttaactggcatactaaaataatgaaattgtgagaatttcctttgagattagtaactgtaccatccatatacaaaacactatattgctttgctgaaacctgaaagtgagcaaactgatagaaatgcatataacaggccgggcgtagtggctcacgcctgtaatcccagcactttgggagaccgaggtgggcggttcaggaggtcaggagatcaagaccattctggctaacacggtgaaaccccgtctctgctaaaaatagaaaaaattagccgagtgtggtggcgggtgcctgtagtcccagctgctggggaggctgaggcaggagaatggcatgaacccaggaggtggagcttgcagtgagccgagatcgcgccactgcactccagcctgggcacagagcgagactccgtctcaaaaaaaaaaaaaaaaaaaacgaaatggcgtatgtcatactcctaaatatatatatatatacagtatttagccttggacgttaaaaaaattaacaatgaatgggggaaggctttatttaaagctaaattgttagctaatacgtgagttcttcaagggtataagaatagttcttattcatttttaagtaattatcggtagccttattatatttttattttttaatactgaaaagcagaaggaagaaaaataaatggcccaaatgatccaactacccagatgttgctgctcaggttaaacgcacacacgcatacacacacagaaaattcaaatcatataaaatggtataaaaaaaagtattcctacacacctgttagttttcataccttctcctcataggtaacaatagttaatttttttggtttatcttctgaaacatttaaaaatatataccagcctataattttattttttgcacctactccataataagtgtatctgtcttcttttgctaggttatgctgctgtagcaacactatcaaatttcagtggcttacaacactgcttttcttcttgcttatgctacaccttgtcagctgtggattgactgcagcattgcttcacgtttcttattttggaaccctggctcaaggagcatcccctgtctgggctgtgccattattgtggatgagggagagagcaagaaaacagatgcagacatacaatggctcttaaagctttcactcagtcatgttgtatgtcacatcagctcacatgtcagtggccaaagcaagtcatatggtcagagctcactgtcagtggggtaaggatgtatagtccttccacaggtggcattgcaagttgcatgataacagataaggctgtataatcctcttaaggaaagtggaggttaaataatttggaacaataaataatatagtctacatcaacaagttcagtaaatgcttgttaaatgggttatttggagtctatgaaagtttctttttttttagtgggaaattcaaacataaacagaagtacagagaatggtatgatgaacctcccttgttccctttattactccagcagttaatgtacggacaatcttggtttatctgttttctttccccccttctcactagattattttgaagcagtttttggatatcataatttcacttacaagtatttcactaagtatttttaagagataaagtctgaacgtgtgacttctcatagtaaattattactgtctgatagggtgaggtaatagtactatatagactgacaggtgtcaagcagcagagcacgttcatagagcgtatctagaatttgacagcctgaacttgttttgatttcattttgagtatttctggaggaggcttacaacagaatgccatctacttttccagcctctccctttctttctttctttccttccttccttccttccttccttccttccttccttccttccttccttcctttctttctttctttctttctctttctttttctttctttctttctctctgtctctctctgtttctctctctctctctctctctgtctgtgtgtgtgtgtgtgtgtgtgtgtgtgtgtgtgtgtagcagaagcaggtaattaacctctggaaaaaataacattgcaacagatttgatttgcagaggtttcatttctcactgagcctctgttggaatgatgccagttgaaaggaatcccagctcttaatggctccaagtcttctgggagctctcagtgatgttattttctttggagaagaacatcagaatcatttataaaaatcctgtgttcacccatgccatttgctctgtggagaaaggatctatcatatctttaagatgatctctaagatgatataaaagtaaagaaattcatctatctaattttagtttagaaatcattaatgccaatttcagctgctcaggttagtttgtcttgaaggcctgaaagcctccattttgattcaagatgtcgtagattttatgagcattcagtataaccagtaagtttgtcatttccatggttgtagggaatatgagacattctgttatggatctaggattaccgtttcacaggacattctttttttggggggattgttaggtaataaacagtgggacacaaaataaacagatataatctcttcagtttgtagattttcaggtgacaatgaggtggcagaagaggatttgtgcagattaggaaataaataattattgtatataacatgatggaaatattttagtatagtaccactatcaaattaattttgtttccttaactagcttctttcattgtgtacagagacacttatattaaagtagtctttatagatatccagttagctttagttttttctaattacattatattgctagtctcatttcagagtccatgtaggaactacagtagaaaagtagctatcattggcttgtaaataaaattacttaattttgagtttttcttgggaaggaaaaaccagttttacagaattagtggagttgattctggttttggttacttgtgacaatatagtctatttaaaatataaataaataaaaatttgcccaagaagaataagtttgacttgccatgattcatactgtttttctgttgttgtatcacaattgagaacattagtttcagaggtaatagtttgtcagtatgggtcgagtagctctaatccaaaaatccaaaatcagaaatgcttcaaaatctgaaactttttgggtgccatgtgccacaggtggaaaattctacacgtaagtacataatacaaactttgtttcatgcacaaaattatttacagtagtgtataaaattaccgttaggcgggggccaggcatggtggctcaagcctgtaatcccagcactttgggaagtcgaggcaggcggatcacctgaggttgggagtttgagaccagcctgaacaacatggagaaaccccatctctactaaaaatacaaaattagctgggcatggtggcacatgcctgtaattccagctactcgggaggctgaggcaggagaatcgcttgaaccagggaggtggaggttcaagcgagccaagatcatgccactgcactccagcctggaaaacaagagcaaaacaccgtctcaaaaaaaataataataaaaaattaccttcaggctgtgcatatagagtgtacgtgaaacattaatgaattctgtgtttagacttgggtcccattcccaagatatcttactatgtatatgtaaatgttccaaaacacaaaaaaattcaaaatgaaacacttctggccccaagcattttgggtaagggatacccaatgtgtacctttgttaggataatatacttgtaccttggttgtattttagttgcaattgttagttgcacaatttgggggaatgtttgaggtctctatagtagttactgtatttaccaggaagccctgcatgattagaattcttgagacagtgtataaagttaaattgggtgtgttgcctggatgtgaacagtaaaaaaggagaagcttctcaccatacaattatagcttaaaaggaaccaggtacaattctgtttccaaaaatagaaagtaagtcaaatattatatggatatgtaatagtaattatattaattttgactccctggccgactttttttttgaagctatcattttttgtcagagataaaaagtagcttttaaaggaaaagatatctcagcccttaattatgtgtgtgtgtatgtgtgtgtatgtatttatttatatattttagcccttgtaagagaggagcagtggaagggaactgaaggagcatgatatagagaaaagagcctgggttttggtgtgttgcatttgttctgttactagctgggagaccttgggcaaatttacctctctgatcagcagtttaattttttcatctgtaaaaatgggaagaatacctactttgcagaattgtcgtgacgattaaatgagagtgtgtgtgagtacctagcacatcgtaagagagagctcagtaagttatagtagctgttattgtttaaacttcaggaattagctaggttttgctagaactttcatctgtgcttgtaagatctttttgaatccatatgtatttttagcagctgtggctaagatagtttttttcccttgctgtgataatattccttatcttttatatttcaggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagttctgtatttattaacatcagtttgtttatttattcagtaaatattgaatgcctgttctgtgtaggtcattgtcttggcagttattttgagctcttgctacctgctgaattatatcttaaaatgaagaaatttacatgatagagtgatatttattcatctgtgctgaagattaaagtgagaagtatgtggcaggcgcggtggctcacgcttgtaatcccagcactttgggaggccgaggtgggcggatcatgaggtcaggagatcgagaccatcctggctaacacggtgaaaccccatttctactaaaaatacgaaaaattagccgagtatggtggtgggcacctgtagtcccagctgctggggaggctgaggcaggagaatggcttgaacctgggaggcagtgcttgcagtgagctgagatcacgccactgcactccagcctgggtgacagagcaagactccgtctcaaaaaaaaaaaaaaagtgagaagtatgtgtatttgggggaagttgtagaatgaaataataatgattaaattgatcttatttccaaattttaaaaatgtggttactttctatcacatactgtctttttatgttttcctttttattttatttttcagtttagttatatttcagtgaactatttagaccaaaatggaaaagacattggtgtaagttggaatctaagaagttttagatgttcattgcttttgaacagaggaagtaacattttatggattgggcattgttttagtcactacttgaaggagaacctcttactcattatcagtctcttggaaatagcaactgattaagcctatatatactttgtgcatccagtgaaaatgtgataaatatgatgatcttttggtcagagaaggattctggaaactgcagtagtttgattagtaagacagtgtttaaatcatgattacttgttgctctaatattttagactttgaaagatgacaagatgtgatgtaggtgacaaagagcatttttaaaaatgggtgaaattggccgggtgcggtgactcacgcctataatcccagcactttgggaggctgaggcgggcggatcacaaggtcaggaaatcgagaccattctggctaacacggtgaaaccccgtctctactaaaaatacaaaaaaaattacctgggtgtggtagcaggcgcctgtagtcccagctactcgggagactgaggagaatggcatgaacccgggaggcggagcttgcagtgagccgagatcaccctactgcagcctgggcaacagagcaagactccgtctcaaaaaaaaaaaaaaaaaaaaaaaggtgaaatttaggcctatcaagatacttgggatgtaggaaaggaatatatatatatatatatatatatatatatatatatatatatatatattttttttttttttttttttttttttgagacaaagtctcgctctgttgcccaggctggaggctggagtgcagtggcatggtcttggctcacttgaacctccacctccctggttcaagaaattctcctgcctcagcctcctgattagctgggattataggcacccgccaccacgcccgtctaatttttgtatttttagtagagacggggtttcaccatgttggccaggctggtctcgaactcctgacctcagatgatctgcccgcctcggcctcccaaaatactgggattccaggcatgagccactgcgcccggccggatgttacatttattgagtacatattaagtactgctcactgttttaggtacttcctgtgcattgtcttttttaacctttcaactaagctaaatactgttgtccctgttttaaaactgggaaaaatgagcctctgagaggttcactaatacccaagctgacatagtttctaaacagaagacttgggattattactccgatgctcgcttttttgaaactactggtcacagtcgtttgtggttattggctcatctagatcaatcaattggatgaaacccagaaaatagattttgtcttcaacaataccattaaagagttgccttcacattaaaatttaataactacatcttatcctttgtactcttaatcacctgttttccctattttcttttccagatttctgacatgagggattttgtctcatttgctctaaagagtgaacctaaacattgtgtttaggtttgttattagttgctttaaatatatacacatctgtaaacattgaacttttttgatgcctcatctgtgttgcttatagatcattttccatcataattattttaaagtccttttaagaagtttaaggcctatctcatatatgtaatatattaatagtagataatcaggcctttggaagcataaatgatgtaagtaagttgggttgcagttttttcttatcaagaatctgcgtgtgtttaagtggcagtggagataatatttttatttgcgttgttatagtgttatctttatcatttagtttatattttctgccatttaaagataaaaaggttttatcttttatagctatagagtcatcttctgagccttaaaacacttgtgttttttttcttttcgccgtgtgggtggggaaaggggtgtgtggcaatggccctgtgctttgcctctgcctgagttacaggcgtgctttgtttgcctggctggggtttgtgtctcccatgctcaggagggtggaaccagtttcccagggcctgggccctacctattgtcattctccccataaggggatctgttacgtgtacttgtgggaccacacagtgctctgggcagataagcctcttcctgcctatatcagaaccaacatagcccacacacatctgggaaagcatgccagggtcagcaccccaggcgccctgtactcccagcccattccccttcttcttcccactcacctggaatccctgacccaaggctctacctattggttctaatattctggtggacagaatctaagagtccagcaagctcagaatctcaggacctcctcatccctttaggaaccatcaattaatctcatgatttcaggttgaaccactggagtcaatttcagaagttttggtctatctcagaaccttcagatcacactcaaaagcttggggacagcctcagaaccttgggacacatctcagcatacagggtcatcaatcttagaacttgaggtctgtctcagaaccttcatgcgaaactcagaatcttgggaagtcccaggaccttgtgcccggtattataccattggatcaattatcacagtcgcagaatcttgaggtccatcttggaatggtgcagtcagcctgaaccgtgggatcaagttcagggacatgagaacaatctcagaaacttctggccagtcctaggtctgaaaaccttcaaaacagcaacagactcttgcggtccatctcaaaacttgagattgtggtctaaaagggaccctcaagactatccatccagtcccttcctggaatacaagtcacctccacagcctccctgatctcgctgtctagtctttgctatgagccctcctcgatagggatacctggcccctacccactgcctgccttgcttctggatggctccagctactaaatgatgtctccaaaatgtgagaatctgaaatctgtctcctttttcccacatcagccctctgagacctctgcagagatttcaaggcaagacccatatgctcagggtaagctttgtcccagactgcccacactgggttcctcccctgacttccagatctccacccgcccttctgaacactgttatctgcaacacagttacctgtttatgcatttcaattttgagcctataggatatctcatactgcaaaggaaaagcccattgggaatgtctggggtggaggtggatgcccaaccctgtgctgggtgatgctgggggaatcacagcaggatacagagccccagaaccccatggggtcccagaggaggagcccagaggaggaagcgggaccatacctggaggggctgcctctgatctcctcagagactaggggtgcagtgggaggagaagataggagatgcctagagaccctggccccacagagatgcctgtgagaagagggaagattcctgtttcactattctcaagagctgggagaggcttctgagagagaacctgtaatcccagtcggcccaattacagataggaaagataaggctcaaagagggctcagtcctaccccagagtggttgggtgagtcaggactaacaagtcctctttcccattcccctgacatcataactctccccaccatgatgttatgttgctgcatttcagtcttctcactggccatcttctcacattccagcttgacactaactaggaaggagagagaccatgggggtcccacacaccccatatgagccaaagtgaaaaacattgttacttttaatctcatttcttctttgtaaatgattttttgtctctgaaattctgtgacatgaatcagtttagtcactttttatcttattaaatggagagaaaaattgcttaagagatatttaggtgtgttgttttttaaccctttttggttgtaaattgttttctttctttgttttagtaaccccagaaaatctagaagaaaatctagaagagaggtaggcagatcattggtttaaaaaaagaagcccaccaactaaatcttttattgagtaaagtattgtttctaggtagagaaagattagagaattgtattgagaattttactaggtttgggatttacaaagaggctaacatgcaaaaggcagtgctcttcgaaggagtcgtatagatgtggagactttatagcccttagggagatctacagacatccgctatgctgagttctgggaagctgctttttcccatgcttgcagcctccccgtggggtaaaggtctgttagttttgcataaatatttaccatatctcattttagctagcattgcttcctcacactgttagcactaaggagaactttgcttatccagcttgaaaaatttactgtgatcgatatgactaatctggaggatgttctgtcatctttgagcattgatgaagttaaaaagtcagattggcaaaaataatgagggggaaagcaaccggttcacagttgacaaacatttgcccatgcttgttttcccatatttatttttttaaacgagaaggttattacacaagcagcatttcagtcttgtcacacccaataaattattgttgcttttatatgtttatttgtatactagtcgtttacatttgcatttactatacttttacaactgtttccttattttgtaaccatgaacaccagcttctacatgtaaagcctcattctaggtactttatatacatcatatttaatagatataataattgtacaaggcaaatgttattcccattttacagatgagaaaaaaacttagattcaaagacattgattgactagatcagtatttcccagctataaatttttttggaaccaggttttaaattcaagtcttttagcggggcacagtacctgtagtcctagttacttaggaggctgaggtgggaggattgcttgagcccaggagctccaggctgcagtgagctatgattgtgtcagtctacttcagcatgggctacagagtgagactctgtctctttaaaaataaaaaataaaaaaacccagatctttttgactcttgattcattacatttgctactgtacccaattttatgttactccaaatgaaaatattcagccaaagaaggttatttaatctattttaagataaattacaggagtaatttctaagttgtgttacagggaatatccaggacactttaataggagtgtatttttttgactcatgagccctacaacattcaggcattcaaggccaaaggtagaatgtaaaatgatattaaaaggcaaccttcagactttgagtttattattttaaaaaagatccagcttattatggaaaaatggcctaatccattttattagtcaaaaacaatccaacatttgcaatttcatgtgattcaggctaggagcaatctatcagtatgactgcgtcttaaatcttgtcaatatttgataggattctactttaaaatttttgtgtttttgtgtctcttaccttctacttctccttcactccatgtcttttttaaaattttttatgtttttgagaccgagtcttgctctgtctcccaggctggagtgccgtggcatgatcttggctcactgcaatctctgcctcctgggttcaagcgattcttgtggctgagccacccaggtggctaggattacaggtgtgcgccaccacacctggctaatttttttttaagtagagatggggtttcaccatgtttgcccagctagtcttgaactcttggcctcaagtgatctgcctgcctcagcctcccaaaagagctaggattacaggcctgagccactgcgcccagcctccccttatctttttgcatgtacactttgtctttattgtcatcactaagcttttaatctttcctttgttaccccatctaggtcctctgctctccctcaaccttttacttatttctggttgagcccttttgtcattccctgcaattttctgaccatgtagtagatacccagtaggcttcctggattacttggtttttctgtattttgctaaaaagttactccaaagatgataccttctatttggacctttcccaccctttatatacctatctaggaggtagtaacccaaccattaatctctccatgcaaaatacatgtattgactaaaaattatgtgctaggtactgtaatgtttcctacccattattttacttaattctcacaattactctgtgaggtattcacaggtgaagaaagagaaagtttaagtagcatgcctagtgagtggtaaaacttggattttagtatgaatctgtctgacttcccaacctgcactgtttttttttttgttttgttttgttttttttgagacagtcaccctctgttgcccaggctggagtgcagtggcgtgatctcagctcactgcaacctcagcctcctgagtagctgggactgcaggcatgtgccaccgtgcccttctaatttttgtatttttagtagagacggggtttcaccatgttggccgtggctggttttgaattcctgacctcaagtgatccgcctgcctcaacctcccaaagtactgggattacaggtgtgagccaccatgcctggccccagcctgcatgcactcttaaacactatcctatactgccagatatggtcagagttgaatcagatactgtttctgccttttaggaacttcgagtctaatagaggaagatagagaactaagtgcacagggcacagtggagactgaaaggagaaaaatcattactttttggacagatcacagacagcttcatagaggagatgaatatatttgctgaatcctggaatgtgggatgtagttactggacaggtaagggatagaggaacaattcaggtaaaagaaacaatcaggtttttttgagacagagtctcactccatcacccaggctggattgcagtggcatgatcttgcctcattgcaacctccacctcctgggttcaagggattcttgtgcctcggcctcccaaaatactggaattacaagcacgtgccaccgcagctggctaatttctgtatttttagtagagacaaggttttgctgtgttggccaggctgtccttgaactcctgacctcaagtgatccgcccacctcagcctcccaaagtgctgggattacaggcgtaagccaccgtgccaccaaaataaggaatattaataaggacatagaggtgaaatagctcacattttcaggaactgcatatagttcagcatggctagagcatggaggttgatgatggatgggcacagcagttggtaaagttggagtgataggtggtaccagattatggaaggccttttaagtcattctaaggagtttggattttaacctctggattgtagggagccactgaaggccttcagtcagagaggcagtaagcgttatgttataaaagattctttcggtggtagcgtgaagaaaggattagtcttgagcaacagtttcaggggcagagaaaccaatagtgagacatttttcagtaatccatatgaaaaatgatactaataaattcctaaactgaagttgtaacatatacttaaaagcgaagagacaaagttattaagaagatactaagaataccagcagggtgaaaggtgtgtggtcaaagtgtggggctttctgggttgtgtccttgggtaggggttggtaatacttagcaagatagggaatgtaaaagggagaaggcagggttttgttttgttatttttgtttggctgactgataagatggaagatggagaagagaacagacatagtaagggatagatttagtttaagttactaaatctttagtttaagtattcactatctgttgtatgatagattatcccaaaacaataaacttgcactatccactatggtaaccacaagacaaatgtggctatttacatttaaattaattgaaattaaataaaattgaaaattcagttcctcagtgacactagccacatttcaaatattcactagccacatgaagccagtggctacagtactgttggttgatcatagaacgttttaaattattgcaaaaagctcttttggacagtgctgccaaacatttatcaacgcatagtttactaagatcagaaatcggtgagcaactttgctgggtggttctgcttcaaggtttctcatgaggttgcagtccaggtgtctgcaactagaagcaagggcttcaggaatctgaaggctcaactgcacctggtgggtccatttccaaggtgacttactcatgctggtcaagtgagtgctgattgttggtaggaagccctagctcctctgttggtaggtggacttctctgtggggatgtgtgaggcagctggctttgccctgagtgagtgattttagccagagagggaggtagaagccattataacttttgtgagctgacctcaaaagtcacactacatcatttctataatctgttggttacacaggtcagcactattcactgtgggaagaaactatacaagggcatgaataccaagagtcaatggggcccattttgtttttttgagataggatctcactgtgttgctcaggctggggtgcagtggtgtgatcatggctcactgcagcctgaatctcccagcctaaagcagtctctcatctcagcctcccaagtagctgggactacaggcatgccaccatgctcagctaattgtattttatttttatttatttatttatttttggtagagatagggttttgccatgttgcctaggctggcctcaaattcctcggcacaagtgatctgcccaccttggcctcccaaagtgctgggattacaggcataagccaaagtgcccagcctattggtggtcattttggaggcttcccaccacaaatacttacggaatatctgggtacaaatatctagtggacaactaaatgtataggaatgagttcttagctagtgctattatatttgtgatggtagttgaagaaacttgaataggtgtagatcaacaaggatgagattgaaccagaaagacagttaatatagtatcttgggtcacatgtttggggaggacagaagtactttcaaaggctggaggaacagctacaggggagtagtagtagaacaggcaggggagtacattataaaggaaacttgaagggatgaaagttgaaagtagaatgtaattaacattgttcagtagttaaataagagtaaaacttaacagagtcattctttcaaaaaatatttcttgaatacctgtgtggggaaccagagaaagattggtagataaataagaccaagtctctaataacacgtaatactatctgaggagacaagtttgggaaggtttcttggaggaaggtaatattttaaggtagagactctttaaagggtaaggaggtgagttgggtattttaggggtgtggtggtagagatatggatactaaagtggacatttcaggctatgttagatgtggaacactgctaggatatgaagttttgtgatgagggaaagtggtgagaaaagaggctggaaggccaattagagtagtcttgaatacatgcatgttaaggaacttgcctttatcctgctgactgtttcccatacttaaatttggatactactttagtgatttgccataggcttataacccctaaactgtaagttactaaacatttttctttaatattactctttattattttatttatttattttgagacaaggtctcactctgtcactcaggctggagtgcagtgatgcggtcatggctcgctgcagccttgacctcccaggctctagtgatcctcccacctcagcctcccaagtagctgggaccataagtgcataccaccacattggataatttttgtattttttgtagagatgaggtttcaccatgttgccccaggctggtcttgaactcctaggctcaagcgatccgcctacctcggcttcccaaagtgctgggaattcaggcgtgagccaccatgcctggccagtaatattactttttaaacttagaaaccatttccagagggaacttcattgtattgttataaatagaaaaccagtattgtttgctacatataaaagagaatagaaaaaatatgaatgattattacgttaaaaaaattaaaagtggaatgtagcaatgcatcctttgatatagaaaaatgcccacttggaaataagttcctcagtgagaatactatttttggtcagttagcaataaaagggcctttgcttgaatagtgtttggtttctacctaagatgagattttaaggtcattaagacaattccatttttaaattttgatgttaataagcaccaagaatcacaactctcaagtctgcgtacttggaaagatcataatacagttaatggtcaactttgtccaactttattgttaattcaagcactaataaaaattaagcccttttgttccaagaagccatctaaagtagtttatagcaggggtccccaacccctgggccagggctgcacagcaggaggtgagctgccagggcgaaagagcattactgcctgagctccacctcctgtcagattgctggggacgcattagattctcataggagtgcgaaccctgttgtgaactgcacatgtgagggatctaggctgcacactccttaagagaatctaatgcccgatgatctgaggtggaacagtttcatactgaaaccgtacgtacactcaaatccccatctgtggaaaaattgtcttccactaaatccgtccctggtgccaaaaaggttggggtctgctcatctatagaatctattcttctgagtgtgtcaagttatttattggacatctggaaatggagaagggattttttttgtctactctttgctgccatccagtttgggaaaattctcgcaaaaattttcaaaaatttcaagcatcttttacaattttcgaaatatttccagtgagtttttcagaggaatccttaactggtcctttcagagaggaaaaaagtatccagctcacctacatatctcatagttctagtttcacatttatcttgttcactttgttttgtacgtggaatacgtaaacttgtcaggataaatttaggttgttcacataagtagatatatttgtcaagatatgcttatttgcagagcctgtctcaggcatgcacatgatctcacaaactgaagatttcttccagaaatatttgaaatttttcctgcagctcaaaaggatgcatgaagagttttccactctttttgccaaactctatatgtagccccaattttgaagttacttttataaggttttaaataaatggttttgaactgtaatgactaacaaaaggcatgtgaatgatagtgctagagatgctgccaccaaagtaccaagaaagaatatcatgcttgatgataaaataaaagctttggagtgtctcaaattggctgaatacatttaatgagctattagaggaaacatggtaaagatggatggtcatttagaaattctaaagtcctgtaatgttgaggaagctaaacattatcaaatcttggaagaagtaatcaatataggaagaagaaggaggagaagcaatactttggatactaagcaatagtttcaatactaagttgaaattacttagctaacctcaatttaatggactcactacatttcctctgcagaacatgacttttacccagtgagttaaatgcttgtgtctcatggctattttgtagtgtgtctgaatgcttctacttcgtccagttgaattgtataatctcaacccgttgtacttgaattggaattagatgatttagttaaatattatgaaaactgaaaactgatgaaatctgagcaccaaaaagaaagttatttctataaacagtgagttgtgtgtgctttggaaataagagtagagacttgtcactgaaaaaaaattctgtcaaattagacgtgtatacaaaacaattattatttggaaagtatcttctagattattatgaatgtctttcgtttcttgctccactctaaggaaacaggaaataaatcatagctgatatattttaggacagtttataccagaaagctgatgggacactccaatcaacagacccctacttaaagaaacagccaggcgcagtggctcatgcctgtaatcccagcagtttgggaggccgaggcgggcggatcatgaggtcaggagatcgagaccatcctgactaacacagtgaaaccccatctctactaaaaataaaaaaaattagccgggcgtggtggcaggcgcctgtagtcccagctacttgggaggctgaggcaggagaatggcgtgaactcgggaggcagagcttgcagtgagctgagatcgcaccactgcactccagccttggcaacagagcgagactccgtctcaaaaaataaaaaaagaaaaaaggaaaaggctttgatcctacattttaaaattggcaaatgaatgtacatttacataagttgaaataaagtttaaggtttgtatgaatggtttttaattatttcctgctttaactattcttttccattaaatgaccaaccactggtaccagtggattggataagacagttggcactgcgtggataaaggaggtttaaagaaaaggaaacatgaaatgccttctttttgaggctgctacaataaccaagttacaagtgtgctgattaatttattattcctgtttccagaaatgtcttatttgtatttcatttttaatatttttaaatttaatagtttacatttcccccactagtgttgccttctatttgtagcaagttaatactggttttctatttataatagtgagataaagtttcctttggaaaggaatgttacctttaaagaaaaacattaggtgactaataatttggtgcttatgtgactgtggcaaatcatgaagatagtattttaagtatggaaaacaattgctaaccagcaagataatgtcaagttccttaatatgaactcacttcttggcctttgtctaccttctccagcttcatgtcttaccactttcccttattatggacttcatgttgatcaagtggaggctccctctcctcaaggagagtccctaggccagattcagaagatggttggtagagaggggatttgatagcttctgaggacagtgctttggatggagaaatatcatgcaacttaggacagtgctttggatggaggaatatcatggaactttagttttccagctttattgagctttgcctgtgatattcacttgtttggggggctgtttggagacagggtctcactacattgtccagacacaatcaccatgtactgcagccttgaagtcctgggcttaagtgatcctcccatttcagcctcccaactagctggaactacaggctcgagccactgtgcctgactcttactcacttttttgttcccaatacctggaagaagatcgtcagtctgtaaatatttgaaatctaaataagggttatggtgctgtagtataaggccaaatcttgggcaccaaacaaaaaaaaatttagaaaaatcccttagcccatcccatgctgtgctgggagcttcatctttctttttaattgcaatttaaacgatctactgctacaagagggttgtggtaaagcagaatttcttatactgtgcaggtgggcatgtaaattggtttaaacttacagaaaataatttgacaatatagttcaaaagcctaagaaatgtttaaactttttgaattagtaatgccaattttggtatatatctcaagacattaaggatatacagttttagctgtcattttatacaaagagatcacccacaccattattttagtaggggcaaagaggaaccaatgtaagtctggtgcctctgaagaggtagacctagaaactgggatgacaaggaactcccaggggactgctgttaataaattactttatgtcatttgataaaatatatgtaagcattaaagacattttcaagtaaaccttagtgaggaaattgttcatgatctgtgaaaagtatgggataaaacttcaaatataatgccagttacatttttaaaaaacattcatgtgatgcttttaaaaagacttctaggacatgtaccaattttttttttttttttttttgagccaagtcccactttgtcgcctaggcttgagtgcagtgggcacaatcacagctcactgtagcctcagcctctcaagtagctgatactacaggcacacaccaccatgctcagctaattttttaattttgtgtagagacaagctctcactatgttgcccaggctggtctcgaacttctggactcaagtgattctcccacattggcctcccgaaatggtgggattataggcacgagccactgaacctggcatgtactactttttaagtgtttctgggttgtgagattatagatgaattttgttttattcttcacactcatatgttgttttctaggcttttaactatgtgtatatatatatattgcctttgtcatgagagacacttttgtttttaagtgaaacctctgtttagtttttatttatttatttgatctttattttaatggaaaggtaactgtgctggtaagctgatagatgattggaaggaataattcttgagactaggaatgcaaatgaaagactgctgggagatatgagaagctcctgaactagggcagtggtgataggattggagaggaatatcgtgatcagtaagacataggaataaaggaaaaagagggatccaggatgactcccaagtttctgggtgtttaaatgtaatacatttgagatgaaagtttggctcttaaaaaatattcttatttggggaatgtttaaatttagtgaggtcattaacaacttcagattccttttatacttcaattctttaaattctatatgttgccaaagatcctacttctaatttgttagggttaacaagaagaaagatgatatgtctgtgaagacatgtttctgacatctgtcaccctatggattgccagttgatagacctggttgtcttgataagtattagctgactccccaaccagtttatttgcaccacttctgaagcaataagcttggttgaaaaagggcacctcccaagtagggaaggataatttttaggtcaaattatagaaattgcatgtatccctgttaacacttccaacaccaacaaaaaaatagacaggaaaatgaccctaccagctaattctccattataagactttgaagaaaaggttccattaaaaacagaaaagaggctgggcatggtggctcatacctgtaatcttaacactttggaaggccaaggtgggagaattgcctgagttcaggagtttgacaccagcctgggcaacataacaagaccctgtctctacagtaagtaaaaaattactggatgtggtggcatatgcctgtggggccagctgtttgggaggctgaggtggaaggattgcttgagcccaggagtatcaggctgcagtaagccatgattgtgctattgcactccagcttggtgacagagtgagaccctgtctcaaaaaaataaaaccttgaggacccaaatttgatttaaatttagatgtactatctgctttgggagagttactttattattatttagtagagacagggtctcactatgttgcccaggctggtctccaacttctggccccaagcagtcctcccaccttgggctcccaaagtgctggggttacaggcgtgagccaccaaccctgcccttaagttatttttttgatcttttcatgacatgctgtgggcaataaaataatacagtgggtgatctgttgttgcaattcaaatatggagttcctttttcttccacaaaagtattggctgatttctttctttttctggctgtgagcaacaggtaaattaacatgaccatggtctgtccccagcgtcttgactcagatttcttaatttgaacttttccatcttctccactccaagatcacatgacaacatccaacatcagtggatagaaataattagaggctggatgaggtggctcacgcctgtaatctcagcactttgagaggccgaggtgggcggatcatttgaggtctggagttcaagaccagcctggctaacatggcgaaaccccatctctaccaaaaatataaaaaattagctgggcgtggtggcacacgcctgcaatcccagctacttgggaggctgaggcaggagaattgcttgaacctgagaggcggaggttgcagtgagccgagattgtgtcactgcactccagcctgggtgacagagtgagactccatctaaaaaaaaaaaagaaatttaataagtcactgctacactggcaaagaagggttgagtagttttaagaagcttagttgctgtccaacagtcttattgcatctgattcttttggtgcttgcttactcaagtagggatcacatagcatgggaaggaaagagcagatctgtgattctgttgtttacatctcagaattgtggtttgtgaatagttttgaaatttttcttatagttttgggagaaatttgttaacggaatttttaaggattataggacagcacaaaataatttctcttgtttagatgcttttaataataaaaaaaatctgttaggatactttttccttttttttttttttttttttttttttttttgaggtggagtctcgctctgtcgcccaggctggagtacagtggtgtgatcttggctcactgcaacctccgcctcctgggttcaagcgattctcctgccttagccttctgagtagctgggattacaggcgcatgccaccatgtccggctaatttttgtatttttagtagagatggggtttcaccatgttggtcaggctggtctcaaactcctgacctcatgatctgcccaccttggcctcccaaagtgctgggattacaggcgtgagccaccacgcccagcctagaatactgtttaaatgataaaatagctgagtgcagtggttcatgcctgtaatcccaacactttgggaggctgaggcaggaggattgcttaaggtcaggtgtttgagactagccctggcaacgtagtgagaccctgtctctacaaagtaatttcaaaattggctgagagtggtggcacacacctgtagttccagctgtttgagaggctgagttgggaggattgcttgagcctgggaggttgaggaggttgaagctgcagtgagctgtgatcgtgccactgcaccccagcctgggtgacagagcaagacctcgtctcaaaaataaataaataaaagataaaataagaccgaaagatttcattatgggatagagaagaaaactaatatggaatttaagataatattcttatatttgagtggcctctttttttgagacagggtctcactcttattgctttggctgggccacagcggcatgatcttggctcactgcagcctggacctcctgggctcaagcaatcctcccgcctcattgtccatactgtctagctatctccatgataacaacatcatcttatatcatgactactgactaaaatccttagtagctgggactacaggcacatgctacaatgtctggctaattttttaattcgtttatagagatgggggtctccctatgttgccgaggctggtctcaaactccaggcctcaagagatcctcccaccttggcctcccaaagtgctgggattacagacgtgagccaccatgcctgacctgagtagcctttttatttaaagggaatcggcatttgtttattacctggtatgttctgagtatcaggctgtgtacttaacctcacttaatcctgacagcattcctataaagcagatacctaacaattatttgtgaggaaattaaggttcagtgactttccataaatttgcttatggtcacacaatccattgagtgcttgtgccaggttttaatctcagtctgaccaataccaaaactcattttttctatgtatgtttcccttttagaaagattttatttttttaattttaattttaattttttaacttttaggttcggggtacatgtgcaggtttgttatatcagtaaactcttgtcatgggggtttgttgtacagattattttgtcacccagttactaagcctagtacccaaaagttattttttctgccccctccctcctttcaccctccaccctcaaataggccccagtgtctattgttccctagaaagatttcataagtaaatgtcatctagcctgtaaattatttttgtttgccagcatttataatataggtggtcattctttaggtgctgaaacagaattggttttgtccttagtgtctggctgtctccaatgataacaacatcgtcttttatcatgactgctgactaaagtactatattctcaaatcttcttttcttctttttttttttttttttttctgtgacagggtcttactctgtcccccagtctggagtgcagtggcatgatctcagctcactgtagcctctgcctccagggttcaagtaattctcccacctcagcctcccgagtagctgggactacaggcgcacacccgcacaactggctaatttttatatgtttagtagagacggggtttcaccatgttggccaggctggtcttgaactcctgacctcaagtaatctgcctgccttggcctcccaaagtgctgggattacaggcatgagccatcccactcggccagatcttttgtttttaattgaaaacttataatacatttcagagataaaggagagctatttcagaactggtgcttattggtaagttttaaagagttaaagtcagtgaactggtggtataagccatttaatcattatgtttatcattttatagatactaatcggagtaatgcagtttcaacaaaagtagtttattttggggtatacaagaatttttattctttaagctaattaattctaaatttaaaagaaggaaaacacctgagaagcttgcgctcttagtgttactacacagaagtctcaatgtagctgcaacatctgattttaaaattttcttttttcgtcttatacttggaatatttcacaataaagtaaaaagaaaatgatatacatccatgtacctgctacttagtgttatctttttgggggacgaggcaagcaaataaaaattagagatgaagtcgaggctcccctgggtattttcccccgatcctgttctcttctgcccctttccagaagtaaacatcatagtaaacttggtgtttgttgctcctatgcatgtttttatactttggctatatgttatgtatcttcaaacattatggaaatttttgcagatttttaaacttcctaacatttgaattcatgttctatattcagcaatgtgtttattaacaaaatatcaataaaaattactaattataactgttactattaataatgaatattaataaaatattatgaatatgatatgaggtagggattgagttttattctttcatgtggagaatcagtcgtctagccccattcactgtgcagtctgtcttttccctactgatgggtagcactatccttgtcatacataatgtttccattatttgtaggtttgtttctgagctttctaatcttttcccttggtttgactatttctgtaccgacaccaaactgttcagattactttagcttcataagcaaagtaaatctccttaccttgtttttcttcttcaaaattttcatcgctattcttagctttttctttttccatatgaattttgggatcagcttgtcaggttcccttaaaagttttatttttttttaacattgtaattgcattgaatatttagtttagtttggagaaaataggcatatttatgatattgtcttcctatacatgaacgtggtttttccttagaaattccagatattcccttatggtcttcaatagtaatttataattgtatccaaaagtcttaaaacttttttggctaagcttatttctaggtactttatgattttctctgcttttagaatggttggtcagtctctttctttccctctcctcctccctcacttattcttttccttcctgtttcttccttcccatcccccattccaacctcctttcattttttttttctctctccttccctcccttatcaccttttaattttatattgttttggctgacagttctatttaaggtagtgtgttatagagaaaagtatatggaacttagagtcaaaattgctggaaatgagtccccgcttcgtccttcaagaattatatgataattaagtcaacttttctgagcctaattctcttaatctgtaaaaggagaatatttacttttatactgtctacctcacagaatcaagtgagatatgtgcatgaggttttttcctaattaaaaattcagtgctaaaaagagttctttctaggggaaaaaaatgccaatttcccccaactaaaagtatagacatttattaaaactgtatctttagggctgggtgcggtggctcatgcctgtaatcccagcaatatgggaggccgaggcgggcggatcacctgaggttgggagtttgagaccagcctgaccaacatggagaaaccctgtctctcctaaaaatacagaattagctgggtgtgctggcgcatgcctgtaatcccagctactcgggaggctgaggcaggagaattgcttgagcccgggaggtggaggttgctgtgagctgagatcgtgccactgcactccagcctggtaacaagagcgaacctccgtctcaaaaaacaaaaaactgtctttaaagaagaataccttaatacataaacttattattttgactcttaaagattataacccttataccccacttcctaaaaaaggatgtgaaatggtttaaagggcacgtaaacatacactcacctcagttaaagatgttaaaaatagaaaatcaagttattacagtgagatcagtgcaaatatgataattatgagggctaatacagccattgtaattaagcctctctgctttcaggattctgtgggaataaggtaaatatgatttggttctattgttggatgtatttcctcctttgagacaaacctaattttactcccattaaattaaaaaaatactgtccaccaaggtttcaagacaatattgggaacaatatctgctacaacagtttcataagtgaaagagcactttttcaaatggttttttgaatgaccgttactaaaaatctgaggggaaaacagaaagcagcactcaccaaaactgatttctttggaaaaactaaaccaaggttatttagatagcttatgatctaatttgtcaggcactgagctggtttataacctagagcagtgatgctttcaacatttttgtgttaacacatatgaacttttgaatactaaaatttttggtaatatgttgaaacttccaagggaacattagataaagtaatagtaactataaggtaaccactagtacagtaaaaatgccttctagttacaaatgaatccaaagcaatctctattttacttaacactattaagcactgcagtctgagtttgattagaactgtttactctctgatctcctctgatcttttttttttaattcaggaaccaaaatatttatatgttctaatatagatataccatctttaacattggcttgaaattatgtaatgcctctggattgtagttatttgtgcttcactataccctgtcatatactggcccagtacaaagttctttctgacaagcctttctaccagtgtgttattaactagtttgctttgtataatgcagttctgctctcaaatacatctaggcaagtaaccaaaggaatcctaggttaactttctgcatttgaaagatgtatttatggaagactgaagcttattttttatatggtaaggcaggtgctcagtttttatggggctttttttccctataatttttcaactttttgtaaaaagcagacaggatttatgataagataggcctgagttcagatccaggctctaccatttgttagctgaacaaccttggaaaagttatatagcttctctaccttagcttttgtctctttatccccaatatctcttatcatgtctacttcataggacttcagatgtgaagtttttaaaaattatcaaactgtaacttattgataattttctgcttaaggtcactctaactgaggaacctacccctagaattaaaaataaatgcacaaaataagctattaataataaatgttgaaaaaagctattccgtattaccagtataatctaaactgaaacaagattttttcttagaagtaattttttctaagtataacaatgctttaaaataaccattatataaaatttctgacatagataaaaattagaatagcttaatgaaccttcactgacctgttaccagctttagtaataaaatacagtttagattaatccttttcaaccatataagatataaagtgacaaggcccctcccctctcccagttgtttaatatgatttacctgaggtagccaccattaacttcctttacacaaatgaaatcaccccataggtgctgttttgtagcttgacattttcatttaacaatatactttttaaaatatgttttatttccatgtgagtacctatgttctgtggctatacaacattctgttctctacaatgttctatataatattatggcagcaaaacacaaaagagtgaaatgagggatgtttgttttatccactgctgtgttcccaacacctagaacagtgcctgcacataatagatgctcaatacatatttggtgaatgaattaacatctagttaggaaatgtatttctaacttggaaatgtatttctattattggtacgatattctattatataattgtataatgatttatttaactagtagaataatgatggatggtaggactttgggtttttttcacctttctatgtttttttcccccttctatgtttttttcccccatattctcttcagggagcaactattatcttgataatggtggcaatttaagaaactactttgagaaaataattaaaatatgaaaaatggattttttgtttttgtttttgagacggagtttcgctcttgttgcctgggctggagtgcaatggcgcgatctcggctcaccacaacctctgcctccaggtttcaagtgattcccctgcctcagcttcctgagtagctgggattacaggcatgcaccaccacgcccggctaattttgtatttttagtagagacaaggtttctccgtgttagtcaggttgggctcgaactcccgacctcaggtgatccgcccgccttggcctgccaaagtgctgggattacaggcgtgagccaccgcacccggccaaaaaatgtatttttatggacacccatagctaaatgtctttccatctagtggctggttaaccaagcatggttcctcctgtttcctttccctatgatcatttcagagtataaccattgtttagtgtaggagagatgttatgacttttagatatgctttttttcataaaaaggaattgcctagttagaattttttaaagatatctcacagttcagcagttttgacattgctggggaaattttatccagggatacagaagaaacgttcattcatttttatttaagcacctataaaaagtaggggggtacttctggcaatacagttgggttactgtttgtggctaaatatgtgtgtgaacattacgacatttgatgaaaacagcttcattgagctactgagctctccagctgatttttcttcttggccttaaaggtttacaaggctaagaatcaatctcctctggggtagatggccttacggattttaaatatgtgttgtgataaaagtgattttactctaatacagcatagtacaagttaacttccagtatgcagaattgacctcgtgaattttagtttaatgatctcagttctcatgaacttgcaaacatagaaaaaaaataaatatttttaaaaaacttttctttttaaattgtgaaaaacgtatatgatggttacagcaaagattatgcttttatgactaattcattacattgagtcatacatattaatgattcaaattactaacatagctctattaaattaaatctaccatacagtatacaggtattctgtactttgaaatttcataaatttttggatatcaactctcagaagggtatactagtaatttgcttttacccacaaaatcttcagatttgtcaacaaaatgaacgagattggtattttcactttagtttctcagtgaaaataaagaatgggtagatgaatggtccaaagagctaagagagaagacttaatttaaactcaaataaacatgcccagaatgaccctctctttttctgcccttcctcctgccacagttagccactgtatgtctcaggttttaggcaaagtgagtcttcttatcatggaaactgtgaacattcattaacaactggttttactttgaaacttaaacagcaaacaccaaagagtgaattgttggtataatccatgggagtcttgagattgacgtcagaacaccagtacagctgtataagcattgggaagtatttttaacatccgtgttagatcatctttttgacctttccttttatgttttctctttttccattaaatggttaaaaaaaagagctttacaatattttctaccaacactgtaatgatattcttaaaaaaagcacccgtacaattattttctttgttcctttcccctttgcaactttcctttacctgtagtgttccaagttctgatggggtggcctttttttttttttttaaataaaaagtttgtttttgagaacagggctagatttgccgaaaatgagaagctagaaaataacatataccccataggcatgctcagagtcccctattattaacatattacatttgtgtggtacatttgttactgaaccagtgttaacattaatattaattaaagtctgtagtttattcagatttccttagtttttacctattgttctttttctttcctcagaaaccacattatatttagtttgtcatgttccttagcctcctcttggctgtgacagtttctcagatttttcttgttcttgatggttttgacagttcaaatgagtactggtcaggtttcttgtaggatgcccctatattagaatttgcttgatgtttttcttacgatttgactggagtatgggttgttggaaggaagatcacagaggtaaagtgacatcttcatcaactcatgccaagggtacttaccgctaacatgatatgtgactattgatgatgaccttgatcaccaaaataatgtttatcagatttctccagtgtaaagtattggaatgttctggtaggcatatcctagttaggttaattgctctggtaattgcttgggctttagttattaaataaatcatcatattggtatactgctcattgaaatgttaaatttttttttttacaaataatgtgttcagagttgagaattagattttttaaatgttcagattgtattttcaaattgtatttttgaaataaagctttcctttcctgtcgaattctaaagattttgtttatctaagggaacaacttaggttcgtattttaagtaggaagttagagagcctggtcagtttatctgcaatttaaattctagacactgagacttatttccttcattttatcttttaaaaaatagactgagatataatttacatataaaattcaccattatattattgttaatttttatgggcataagtatttatatttatggattacatgcaatattttgagacagggatacaatgcatgataatcacactaaggtaaatggggtatctattacctcaagcatttattctttctttatgttacaaacattccaattatactcttctagttatttttaaatgtacaataaattatggttgactgtaatcactctgttatatcaaatactagatcttattctatcgaactatatttttgtatcctttaacaatcccaacttccccaaccccccactacccttcccagcctctggtaaacatctttctatctccgtgagttcagatgttttaatttttagctcccacaaatgaatgagagcatgtgaagtttgtctttcggtgtctggcctatttcacttaacataatgaccttcagttctatttatattgtggcaagtgacgggatctcattgttttatatagctgaataatactccattgtgtatatgtaccgcattttctttatccatttgtctgttgatagacacttaggttgtttccaaatcttggctattgtgaatagtgcatcaataaagataggagtgcaggcctctttgatatactgacttccttaagttcactcattttaagtgtgtacttcgatgagctttgacaagtgtgtatactttttaaccaccacaaccagcatagttaagatatataacatttccatcaccccaaaaaattgtctctgctttctgtcacaatagttttgccttttctacttcatgtaaatgaaatcatgtacagtatgtaatctttctgtgtctgtcttctctgtctctttttttttttaaagacagtctctgtttcccaggctggctggagtacagtggcgcaaacacagttcacttcaggcttaatatcctgggctcaagtgatcctcccacctcatgctcccaagtagctgagaccacacaggtgcacagcaccacacctagctaattttttagtattttgtagagatggggtctttctgtgttgcccaggctggcctcaaactcctgggctcaagtgccctgacccctgcgaagtgctgggattacaggcatgagccactatgcccagcctttcttctctttttttaggcttaatacttttcagatgcatccaaattgtttcatataatggtagtttgttcctttttcttaccataatagtattacattgtgtgaataagtcagtttctttatccattgacctgttggtggaggtttggattgtttccagtttttggctattttgaataaatctgaacattttcctgtaagtttttgtgtggcatatatttttctttctctttggtaaacatctcagagtagaattgctgagtcatatggtaaatatatattaacttttaaaaaattcttttatttatttttttagagatggggtctcactatgttgtccaggctggtcttggatcagccttggttagggatcctcccacctcaccctcccaaagtgctgggattacaggcatgagccaccacacctggccttgattaactttataagaaactgccaaattgttttccaaagtgcctctgtcattttacattcccactagaaatgtcgaagagttttacttgttctacatcctcatcaacacttggtagtatcagtctttttaattttagtcattgtagtgggtgtgaatggcatctcactctactttttatttgcatttctctaatgatgaatgatattgaggacttttcatttgcttattgaccttttgttctcttttgtgaagtgtctgttcaagtcttttaagaagttggcttgtctttgtcttattgagaggtaaggtatgggtcctttgtcagttacatttagaaaatgtttttctttctgtttgtggcttgtccttttatttccttaacaatgtctttcaaagagcataagttattaattttgatgaagttcagtctatcaactttttattttgtattcatgcttcttggtccctatcgtaaatatcttgacttaacccaaggttgcagaaaatgtcctcttaattttttctagaagttgtatagtttagctcttatgtttaggcctatgattcatatcaagttaacatttgtatatggtgtgaggtaaggattaaagtttgtgcgtgttttggcatgttttccagcaccatttgcagaaaagactgtccttttcccgttgaactgctttggcatctgtgttaaaaacttaatagactgtctgtgcatagttgtatttatggtttctttattatgttctgttgatcaatatgcctgaacatattgattgatttattaccttagctttaagtctttaaataaggtaatataagtcttccaattttgttgttttcctaaaaattgttttggctcttctagatctttgcatttccatatgaatgttagagtcagcatgtcaatttctatttacagaaaacaggctgagattttgtggttgtgttgaatctggatcagaatgtggagaattgacatcttaaattaggtctcccaatccattggcataatctttctctccattaatttagtagtcttctttaatttctctataaacattacatagttttcagcatacagggtttgcacatggtttgttaagtttatgtgttttgaggttataaatagcatttaaaattaatttttaattctttattaataatatatagaaatacaattgatttttctatgttcatcttacatactgttactaaacttgctttttggtgctttttttatatagatctctggagttttccataatgtcatgttattaaaaagttttactttcatttaaaagatgtaagccttttatatatttattttcactgtcttactcatttggctgaaatgttaaaagaagtggtgaaagcagacatgtagacatcttttcattgttctcaatcttatggaaagcattcagtattttaccattaagtacgattttttttttttccatactctatcagtttggggaagttaccttctattcctagcttgtaagaaattttataattaacagatattgaatttagtcatatgctgtttctgtatctgtttagatgatcatatggcttttctgttttctttcttttttttgacttgccaggaggtattttcatctgaggcttttctttcttagactggtgatacagtgaattacattgatttttgagtgttaaacctacctggcattcttaggataaaccccatttggtttatcctaatggtctctttattatgtattatgtattattctttttatttattgatagatttggtttactaatattttgatgattgttcttgttcctttgttcctaagggatatttgtgtttagttttcttgtaatgtcattgccttgttttgatactgagacagtgttggcctcagaaaattttttgggaagtgtcatgtgttttcactttcatttgtcagatgtagaattgttatctcttcctttaaatgcttgtgataattcaccagtgaagtgagttttctttgtggaaatgttttcaaccagcaattaaattcactgccccctgagagtacccactattctgacttctagtaccatagactaatccttaaactttttttggattaattttttatttagagaaaagttgcataaataacacagaaaattcacgtagagttcccatataccctacacctagttttcctgattgctgacatcttacattattgtggtatatctgtgaaaactaagaaaccaaccttagtacatactgttaactaaacttcatacttcatttggatttttccagctttttcattaatggcctctttctgttctaggatcaaatttaggataccacattgcctgtagttttcatgtttccccagtctcttggtttgtgacagtttctcagtttttccttgtttgtcacgaccttgccatccccgaggactttgtagaatgccccccagtctgcgtttgctgctgttgctcggtattagactgggttatgcgtttttggaaagaatcctcttttcctctcatcaggggtgcatgatgtccacgtggcatcactggtgatgttaaccatgaccacttggttaagatagtgtttgctaggtttcttcactatactctgttttttgggaacacattactaagtccaacccacactttaggaagggggagatatctacatacatggtttgaaattcttctgtaaggaagatttggatctttccccacatttatctgtttattcagtcatttatatcagtatggactcatgtatgtttattttatactttgagttctaatgctaggtttcttttcttttgcttaaattgttccaactttggctattgggaaggttttccggttactgtttatgtccctttcatatgcccctatccttttgttttttgaacatctcctgacgtggtactagaagatgctccaggctcatcttgtattttctttgcatcagctgtagaatcagccatttgaaggaactagcattccttttatttaggaaccaaaatgtagttactaggtgtgctcattgctattggagtatcgttgcttttaggccctctcaggggacagagctaggtaatatctgtgtgaatactaacccatgtatacacatacatctctaattgtttctatatgtatcagttggcatatatgttaagttaaacatgagttgatattgatgtctctgattataatccattaccacaaggttcactctagtcctcctttttaatctgtgacttccttgtctgaccataagaaacctggctccagccaccccattatccatccacttattttttcaacctatgtacacatgaaaagcaaatttagaattattaccccataccccatgagtacagtatttatgtacagtttcttttgtcattagccttacaatttcaagtcaaaacaccgtgttccaaagtttgttaggtaagctcctttttcaccgccccttcagtgaagttatgtcatacatttgtaatgcagttagtttcatttgtcgcaatccacatttcatcttgggatcctctgacgttttggttgatgttagtggttgttgtttggttaacatttgttgaagttcactctttgtactgtgccattctgtgggttcagacaaatgcaacgggtcatgtattcaccaccctaatgtacagcgcagatcctgcaccctaaatgtccccctgtgcatcccgtttgtagtcaaacactctcctctcctctagtccctagcaactactaatttattttctgtgtctctacttttgcattttccagagtgttgtataaatggaatgatacagtctttggatttttccatgtagtaaaatacatgaaaaatccaaagattgtatcgggcttctttcatgtagtaaaatgtatttaagattcatccatgttgtgtaaattaatagttcatttgttttaaaaattgttgtactattccattgtgtggatgaatcataatttgttttttcattcccccattaaaggccattgtagttactttcagtttttggcattaggagtaaagctgctgtaaatgtccatggccaggtttttgcatggatataagttttcaagtcccttgtgtaaatacctaagagtatgattgtaggtcgtatggtaactctgtgtttaactttcgactgcttttgttctttatagaaatggagttgtgcagtatgtgctcctttttaatctagcatctttcttttgaattgtttatgacatttatctgtatattttgagtggtcataattcatttgcattattgattaatattctaatgtgtgaataaactacagttttaaaaatccattctactgcagatggacatttagatagctctagtttgggactgttactaacagtgctgtttaggaaccttcacagacatgtatttttgtgaacatacatatacatttctgcctagttgtggaattcgctggtacagctttagctgattgtaccaagtaattttctggagtgattgtaccaatttatagtctgatcagcggatgtagtttctaggtgcttaatgtcttcatgagtactgtatgtattcattcattctatttctctctctctctcattgtggttttaatttacatttccttaaagttgagcacctttttatatgtgcattggttatttggatattcagaaaaattaagaaaattgtaaatttcttctgggctctgaaagcattggggtttggaataaggggtggcttccattaggaaaggcagtaagggggccgggcgaggcggttcacgcctgtaatcccagcactttgggggccgaggtgggcagatcacgaggtcaggagattgagaccatcctggctaacatggtgaaaccccatttctactaaaaatacaaaaaattagccaggcgtggtggcgggcgcctgtggtcccagctgcttgggaggctgaggcaggggaatggcgcgaacccaggaggcggagcttgcagtgagcggagatcgcaccactgcactccagcctgggcgacagagccagactccgtctcaaaaaaaaaagagaaacagtgtctttgggggagagccaggtgttggtgaaggcagcgtttggagtgcattctgtgaagaagttaagagtgtagtggtgtttggtttcttgtagcaagagtcctagagcagtggtccccaacttttttggcaccagggaccggttttgttgtagacagtttttcaatgggactgggagggtgttcgggggagggcagtagtgggatggtttcagggtgattcaagcacattacatttattgtctaccttattttcattattattacattgtaatgtataatgaaataattatatactcaccataatgtagaatcagtgggaaccctgagtttgttttcttgcaacttgacggtcccatctgtgggtgatgggaaacaatgacagatcatcaagcattagattttcataaggagtgtgcaacctagatccctctcatgtgcagttcgctatagggttcctgctcctctgagcatctaatgctgccactgatctgacagaagtggggctcaggtggtaatgcgagtgatggggagcagctgtaaatacagctgaagcttcacttgctcacctcctgctgtgtggcctggttcctaacagatcatggaccagtattgtctgtggcccaggagttggagacccctgtcctagagtacacagtgaaaaagtttgatagagaggggaacagtggaagattttgttagatatgtcacatgattaatggatgactaaagttttgtttggtgatctaggatgatagagatgttgagacatgaaattagttggcttcaagttctaagctgtcctgtgtgagaaattgcctcatcagccaacacaggctttgacatatgggtagcttcgtgtttcttaggatacttgggctggtcagaaagtgccaagcatcagagaaactgagacctcggtataggtggaggaagtctaatgatagccacagtcagtagcctagtctgatttgtttttagcaaatctagactattttcttaatcagtaactacttctttagtaactacttacaaggcgactgcctttgccaaggtatatgttctctgaaagctgattcttcatagatcactaactgtagttttgaggttctgtgatttccttcaaaattcacagaaccttgagctataatttatgtggatagagtgattactgggatttaacttaaaattagatgtattcaaatgttttaaggaatatgttttgtaaaacaacatgtttttcattcgttacttatatattgatcccagaaattgtgtgcctgcaaattgtcaagttgggttgatgcttcagaaaaggaaagtagaggctgagtcttcttagtatagcaatgcattttttagagcagtgtttgaggcaaattattttcgcaaaattacatggcttctagggattagattgcatgagtttgtctcttgttcctccctcattctactgtaagaggccaggctgctagttaacagaatgccagacataatgcctagggcatagtttgagacctgggaagattcacaataatcaaacacaaacagacagagtagcatgaagaaatttcaatcctcccagtcttgcttacagatttaattaggcttattggggcagaaaatatttttcctccccccatgtttaaatctgtttctcctctactcccacctcctgtcccagattctctttgaaggggtaatactagcaacaaaaggagatttttttttttttttttgtaaatcctaacttatttggtttatctggctttaggaaaaggagcagtaacaacaaccgaattttaaggtatttgagggactccattttttggcactgtatttgggaaattcccaatttaaaaatcatgctgtactcaagaagaaaattagggtttttttgtggctttataattggatcttttttgcaagtatttttaattttatgagaggtatttggcctgttctgctagagaattatcagccaaatccttgctttctttatattatatatattttcctgagtgatattctagggaaatgtatatggatgctgttctctgtctttccattagcagcgcagtgttgggcttcgaatgatgatggtagatgattgggggtgggagaagaggtggggtttcttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtaatctactgcagtctttgttttctgggtcgtgtataaaatggagcaaaatggtagaaaaatagcttcagtgaaagggatgtacctgttaacaggaataaaatagaaaggaaaaggatatttttacattgttcattattatttctcacaacagcttttaggatttttatcatgttttaaaaaacctaatttgacctaaggaagaaaattcctagttttgaaaacccgtgccttaattgcttagctttagaacaaaggtttttacatccagcattgcaaggatatctttattcaaaagaataggatgcagcattcttatgttacctttttagaactgaattggcataacctctcttgaatcttagagactttgacgtattattctgtgaattgtgatttaattatctcatgcttcaggatggttgtttccctttgatacccaagagaccatggatgggatatagggggtggggattaatattacagtgggggaagggagtgtttttacagagtaaccttcctgtttttgcattggaaactaaattgaaatatataatcattggaaaaggtggtatccatggcaccaatcttatcaacttgaattattttatcctttgttcagtttgtggtatttttgctcttgtcagctgaaatgttgattataaatttgaagaagctgccgagttgctgtgatggcactggaattgcattctgctttctttttctttccaattatagctgtaaatacaggaaccaagggatgaatgtgaaaagaagtaatataaaatgctgaagatatttttggttttctcttgaaagtatttttcatagtgagaattattttcttgtggacagaaagagctaggaccctaatttatgacattaaaaagcatttaagtgctacagacttctctatttaggaaagacagactgaaaacatgttgaagcgtactatggagctttcagttaagttgattatttccatcatggtgatatgagttatcatactgtttgccacattttgaaagctgtttgactcctcagaagtattaacaaattaacaaattcttactgagcatttacattatgctaggttctttagatgtatatcaggtttatagtctagtaaaggatataaaaaactcatgcatatgatgtaccatttttggtgcaagcatataagtattgcagtgttatatatttatgtactgacatgtaggtgttttacataagctactacatttaatcctcataacaacctagtcacgaaattattgtcattcttgttatcctatgcacattagtccaaacaagcaaacaaaaattgtcattctcttttatagatgagaaaatttacattttgagagattaagtgatttaccataagtaacaaagccatgaagtgatgaagcctgggtcagtcagactctaaagctctttccactgtttgtatatgagtagattaaagcattttatcatgattatttgacatcacaaatagtgatgccatgagtgaaaaggagatagggatcctaatctttaatctatgccaagaactgagtgattgagcaaatcatttaacatcgtctgtaaagtgtgagggttggactaggcaaccttggttcatgattctattcagtgtaagagattttcacatatggtctatggaaacaattctcattactttagtgtttttattatatttagtttccattactcatccttcataatgtgctgtacatgttggattgtgtgtggtggggggggagggtgatagagtgcatatcatcttctaacatattacatacaatatacatttatttattaagattattactgtctgtcatcttccttcttcccttcccccaaatatgtcacgaggacctagactagagcctggctacatagtatgcagttataaactaattttttgaatgaatgaataggaataatagacttgtatagtacattggcaaaatatataagtaacttcataattcttaacaccaaaagattccctgggggccaaaattattaatctttctattacagtgatcctttaaggaactaagtgtaagaatcttaaaaagaagaacacctacgaaacaatcaagtgtagtcaagtaatctgaagtttgctggaattcccccatacaaaattattggtagtatagaacttgctaaccataggtttgtttacccagtgttctatttgaaagtagtttactaaagcattccatataagcaaagaaaaaaagcagcaaagtttcttttttgtttatgtgtcactgtatagtctcaaatgctgtaaatttacagtgagtagaaaatattcagaccattgagtcttttgcttaaaagatatttcgtaaggtataacataacgtttactggtagttttgtttcatttaaacattaggcttcttgagagttttaacagttttattgaaatgtaattggtgtataataaactgcctatggttagagtataatttgataggttttgatgtatatacacgattaggaaactatcaccacaattgagaaaataaacatattcaccccaaaggtttccttgtgcattttcataatttctccgtccctccacccctcctcacctatccccaggtgtacccattgacttgtctttggtccttatagagtagtttgaattttcttgctttctttcttgtcattatagattaatttgcatgtctttttgtaagtgaactcacatagtttgtgcttttcttatgtggtctcttttactctgcataattattttgagatttgtctgtattcctgtgtatcagtagttcatttctttttattgctgaatgatatcccattgtgtggatataccacagtttatccattcagctgttgatgggcatttgggttgtttcaagttttagactattaggaataagtttgctttggacattcatgtacaagtttttgtgtgtacataagctttcatctcttaggtaaacacccaggagtggaatggctggattatatggtaggtatatattttaactctttaagaaattgccagactgtttttccaggtgactgtattgtgttacattcccattagcaacattccagttgctgcacaacttcattaatagttggttttgtcagtctttttaattttagccattttactgtgtgtgtgatggtatcatattgtagtttttatttgcatttcatctgatgactaaaaatgtttaacatattttcatgtgcctgttttatcatccatacttcttttgtggattgtctgttcaaatcttgtttttaattgagcttttaattattgggttgtaagagttccttatatgtttgggatataagtgcttttattttttttttattttattttattttgcgacagagttttgctcttgtttcccaggctggagttcaatggtgcaatcttggctcactacagcctcctcctcctgagttcaagcgattctcctgcctcagcctcccaagtagctgggattacaggtggccaccaccatgcctggctaatttatttctagttttagttttagtagagatggagtttcatcatgttagccaggctggtttcgaactcctgacctcaagtaatctgcctgcctcagcctcccaaggtgctaggattacaggcatgagccaccatgcccggccataagtccttttaggtatatgatttagaaatactttctcccagcctgtggcttgtattttcattttttagcatcctctttctctctttaatacttttattgagatataattcacatttccttgagcaaaagttttaaagtttgaattctaatttatcattttttctttcgtagattgtgcttttgctatatctaagaaatatttgcctaacccaaggtcacacctctttgcttctagttttatagttttgggttttacttttaggtctgtgatacattttcaggtagtcttttatttttaatttttgtgggtacctagtaagtgtatgtatttatggattacatcagatattttgatataggcatgcaatgtgtaataatcacatcagggtggatggggtatctttcatctcaagcatttatcttttgtgttacaaacaatccagttgtactcttttagttatttttaatgtacagttaaactattttttactataatcaccctccactacccttcccagcctctgataatcatccttctactttctgtctccatgagttcagttgttttaatttttagcttccacaaatgagtgagaacatgtgaagtttgtctttctgttgctggcttatttcacttaccataatgacgtccatttccatccatcttgttgcaaatgacaggaactcattcttttttatggctaaatagtactccattgtgtatatgtaccacattttctttatccatttgtttgttgatagatacttaggttgcttccaaatcttggctattgtgaataatgctgcaaaaaacatgggagtgcagataacccttcgatatccaggagtgtcctaaatctaaggatgtgtcatattattttttctttatttttttctcctcctgctgttccgggtctctacagtgtcccctactcctttgttttattcgcacacctgggtagtgcctttccaatcaaaggatagttgggtctgcatttcaggtctgtgatctttatgtttagggaaatccgtttcctggtcaaagcctaccagacttccttggtatcactccagaatttaacagatttggcaagtatgttttttagttaatggtttgagatcataatcatttccttcatgctcctcctgccttctatttttgcttttaatattgaggaatgctaatggaatagatttgcttttgctctctcccatctttacctggaattgaacacatatttattgaaggaatgagtggtttgcaggaatgttgccattcaggtggagacatgtttctctttaaatatatagctggcaagttgcccatatggcacatagatattaactgaattatccactgagctctgggattaggagatacagattgtgtaggattgggagttctttctattggcttatcttttcctaaaactatgtaacgggatatgaatacctttctacctaagtatcttgtcattatactagatctagttttctgagtctcacttgtgaaagcttttggttaactattaataaaaaactgtacaaagggaagatgataatggtttctcttgtaaggtggtagtccaggggttgaaagcaagggttctagttagactgtgaggttttgaatctaagctccctcttctactagttatataacttgtatatgttacttaacttctcagaacctcacatttctcttcaataaaacaaggctaaacattttacttatagaattattgttaaaattaaatgaattaatgcataaaaagtacttaaagcagatactgtaagtatgcaagtaaagctactcaagttttagctattattgtaaccattttaattgttaattattgttcttatagataatggatgatgtgtttgaagctatcacctagcacaatttctgactaccaaatgtagtttgaggcttttgagtgtttttcacctaaccattcttcccaaatgaatatttttcagggaagctaaccccaggaaatgtgacacaatttactgtattgttccttacctctataatgtatgtttattctagctggttcatctcttccttatatacaagttccacagaatgatttttttctaataagaattaagaaacctttgttctgatgatgagcttatttaaatttgggtttaatttgatagaaaattaagctgtttccttaatggggaatctggccaatcaccatcctccaccctcccagggtagaattttttccaggaattaaatagctctatctagcagggtcttcctgcctttggcagtagagcagtacaaaggccacattgagcatagctgctggggaaaccctttttccttctctagcctataaatgctgttctgtctctgtgaaaagccctgacatcagctcttggaaaaatccaaatacttgtgttagaacaaggctgaaacacttgcctgggcagagactaatggctgaactatagttctaagtttaccagattgcctctcagtattgttatgctttaaaaaacaaaacaaaaactgtaagtttcagacataatctagagaaattaggatagaaaggacaacttaatagcgcctcccattctttgctagtttcttcttatttttctcttttttctaaaaatctaccttcaagataatgtgaaattcttgcttgaggagtgagggagagaaataatatatcaatattataaactttatgcagtgttttccacatattagatgctgcataagtatttgatgtttgagacaaaataaactgtaaacagactgtacttaacttccttagtgttcaaattagatcatgatgtaaaactctccagtggttttccattatattatgaataaactctaagcctgtttctgtggctcacattcttacattagctggcccctgtctacttctgtggatctcatttcagcactactttactactctcttggtcattttctatgcttaagccacagcggactttgtatttctcaaatacattaatctgcttatcctttgtgactcttgtactagctgtttcctttacctgtaattctgtggcccacatcttcccatggctggctccttcatttaagtctcagcttaaatgcctctaaggtcttttttgaataaactaaattaatgtatttagtcaaataatatctttttttaatagcacttaccacgatttgaaattctttggtacaattatttttttgtggagtttatcttcctcctgtggaatgtaagctgcttgagagcaaggaccttatctgttcattaacgtaacctccagtgtcttgaacctcctggcataggttggtgtttgtgtaactttgtatgtacttggctgcctgtaacggaaaacacaagtcaaactgacttaagcagtaacgcatttactggctcacataaaaaagaaatctagacgtaggcttcagagatttttgatttagggacgtaactatgtcaagggctcagatgctttccatctttacactcttgccatcaaaatcatcctcatcctaaactagtccttaaagatgaatgcgaagtagctgttaaggctgcttgcttcttcactcaggttcagtgggagggagagaaagaagtttcacatcattctctcaagaataaggaaatactttcatagatgccaccagtgaactttgtttctacttttattggcttttttggaaccaattgcttacccaagaatggaattactgttaggccaaaaaggcccatcactgttgctacagatggggttggcttgacctgagtcatctggactctgagaggaatagtagataactgaataaaatcggagttctcttaaaaggaaggctgtggtttctggggtaacttatatcctctgtagttctcaataaaaatgtatggaatgagtgaattcatgtagtaaaaatgtattgaattgtcaggcgtatgctcagcaccataatagttaagtagaatacaaaatcaaatagaatgtggtccttgccttcaaataatttaaaatctagtgagagagccaaattaacggaatattaaaattgttttaaaaatcagttgattaaaataatttaaaagatgaaaaagagaaaagggaaacaacagatgagacaaatagcaagatgatagacttaaatacattagtaatcacactaaaggtaaatggtccaaacaccccaattaaatgtatagactatcagattagatgaaacagcaaagcccaactgtatgctacaagaaacacaccttaaaattaaaaatacacattgtttaaaagtaaaaggatggaagaagatgtgccctgctaatctacattaaaggaaaactagaccacattaatatcagataaagtagatttaagattatagaatatcaacagggataaaaaaagtaatttcgtactgataaaagggtcaatttaaaaagaagacatatctaggcatgtatacacctaatgacaaaacatcaaaattcatgtaacaaaagctgacataactgaaaggacaaatagacaaatctacaaacattgtcagttatttcagtatccgtttttcagtaattgatcaaagtagataaagtaagcaaggatatagagtacttaaacaatactgttggccagtttgatttaattacatttttggaacattccagccaacaaccaaatactttttttttttttcatgtttgcaagcagacatgggacatttaccatgacagacacaattctgggctgtgaagtaaatttcaataaattaaaaggattcaagtcatacaaagtatgtttcctggtcaccatggactgaaattagaaatcaataaaagatctctggaaagtttccaaatattggaaaataacacaattcttagtcaaagtggaaataaaaaaggaaatggcaaagtattttgtattggatgaaaatgaaaacacaacatatcagaatttgttggttgccattaaagcattacataaaaacttatagcattaaacacctattagaaaagagagaaggtctaaaatcaatgacatcagcttcttttttttttttaagacagggtcttactctgttgcccaggctcaagggcagtggtttgatcactacagcctcaacctcctgggctcaggctgtccccaccttatcctcccaagtagctgggactacaggtgtgccccactaattttttttagtagagatggggtctcactgtgttgcccagactggtctcaaactcctgggttcaagcaatcctcctgcctcggcctcccaaagtactgggatttcaggtgtgagccaccgtacctgaccaatttcattttaagcaactagaaaaagaagagcaaattaaaaccaaagcaagcagaagaaaaaaaaaatagagatgaaagcaggaatcactgaagcagaaaacaggaaaacagtagcgaacattaaccccaaatctggttcttttgagaaaattaataaaattattaaacctctagccagctgatcaggatgaaaagagagaagacacacattactaatatcataaatgaaagaggtgacatcattacagattcttcagatattaaaaaaaaataggggaggctgggtgctgtggctcacgcctgtaatcccagcactttgggaagccgaggtgggcagatcacttgaggcaaggagttcaagaccagcctggccaacatggtgagaccccatctttactaaaaatacaaacatcagccggcattgtggcgcgaacctgtaatcccagctacctgggaggctgagggatgagaatcgcttgagcccaggaggtagaggttgcaatgagctgagatggtgccactacacaccatcctgcccaacagagcaagactctatctcaaaaaaaaaaaaaaaaaaaaaaaagataagggagcattatgaatagctttatggcaataaatttaacaatttagatggaatgtggttggtaattttataaattccaacaatatatatacaatatgtaaatatatattacatatacataaaacaggaaaatacataaaatatatatgcactctgtgtgtatgtatgtgtgtgtaatgaccgggtagggtttatcccaggagtgcaagattggttcaccttacaaaaatcaggcaatgtaagtaaatggatggtaaatggtggtaactatgtttctcactgtctcaaaggagctaagcaagagagaagactggaatgaacctgatggaattagattagaattagagatatcagtatgaactcatgctgagcttaatatagatacagatatatggatagctacagaaagaattatagatatgttgtattagtctcttctcacactgctaatgaagacatatccgagactgggtaatttataaaggaaagaggtttaattgactcacagttccacatggcttgggaggcctcacaatcatggcagaaggcaagtgaggagcaaagtcatgtcttacatggtagcaggcaaggagagctcgtgcaggggaactcccctttatataaccatcagatctggtgagacttattcaatatcccaagaacagcatgggaaaagacccccccccttcatgattcaattacctcccaccaggtccctcccacacatgggaattatgggagctacaattcaagatgagatttgggtggggacacagccaaaccatatcatgtgtatgtataccccagttagtataacacattcatttccctgctctctctgctgagagggcctagaaatggtgacatctcagtagcagtgagcgcacccagctcctggatcttggttactaaatatcactctccaataaaatagctccttggagaaatggttgactctaaggctgcaatagggaaaatgcaagttgaacctagagtgccttatagtgccacaaacaagaaagtgcccaaacagaagggtgagagcatgtcagtggcataaacgggaagaatttgagcaagagaataaataacgtagtattggattagaactcaaagtctaaaataaacatacatgagcccatactgataaaaatgattacataaatacatgggtgagaaaacacaaatcttccttacaggaaaatttcaaatagtatacgtagattcctattcccaggagatggagcttaatcctctcagatgctagtgtggattgggcttagtgacttcttcaaagaaaaaaatatggcaagggaaaaataataactttacagggagacgtcgagcaaccactcccttaaccaaatgaccaaagttaacattactagtgttaagtcatattggtgtcatatatcctctgatgggtgatgaaaagggtacttcacccctgtggtattccaaaaatagacccacgtatatatggaaaactgattttcaaaagtgcaaaaggcaattcagtttcaacaaacggtgctggaacaattggatttcaattggatatcacactctatataaaaattattacaaaatatattgtagacctaaaagtaaaatagaaagtcactcagctcttagaagaaaatgtaggggtaaatctttgtgatttggggttaggcaaagatttcttaggtatgataccataaacatgggcagtgacctaatttccaaataaagtcccacaggtatggaagttaagacttcagcatgtctttggagataacacaattcaacctgcaacaaatataatggttcccaattaggactgctttcatgtttaatacagagaaactgagaatctctatatgagtttagtgcttttcacatactacctaagaaatgcatcttccacatttacatttagtcttccaatgtgttggtgttgtcattaacaaaatacaaattctcctaaaaatattatgaattgtagctttgggcatttattcagtttgtggatagtataataattgctattatgtgtatccctgggttttgtttgtgtgtttgttttctactttcaacacaaatagggagagagtctctctcaccgatttcgtgccacactttgtcacttgggcattaaaataattttaccctggccctttgtcttacaaggtctgttgccaaaacaagcttcttcagcttctgctgctgtttccataaagatttgacatgagttcatggaattgatctcggggacgagtgtgtcctctcttttctgtttacctagtacccacagaaactcctgtcatttctagtccaaactcccacctggattccttactataaatgaattcatcccaaggaagaaatcaagggggagtatagaacttgggttacaaggatatttgttataacattctttattatgctgaaaaattagacccagcctaaatatttacaaaagggaacttcttaattaaatagccatatcacaggatactttgcagttatcaagaattatttagaactatgttttttaaatctttatctgatttggaagttcaatatatagaatgaataaaaaacaaagcagctctgatatgtgggaagtctagagccccatctacacactcccgctctgtgagggacctcttttaaacctctagaattttatagagcacagtttaaaaccagcactgtagtgaaatatttaatatgtaaacatatgttgatattttatgaagttaaagttgtcaatatgtccagtatgctttaatttttatgaaaataaattttaaacattgtatacagaaatctatctctattttgggaaagaatgggaatatatgcataacaatgctgggtgttgggattatgggtgatttttgtttactattttgtctttagtttttaaaagtttatacgtgtacttctttggacataaagaaagtgagacatttcttcatattgaaaaggcagagagaaccattgctttataggaaactacagtttggaaaaacggcagtctcattactcaatcccttgagagaggaattatcttgaaaatgttataaaaaatattagtaacagatttactagtgtcagtggtcttgtgtgttaagtatattaggataagccacatttgtaacagctaacggagaaaacataactgaatgtcagtgttacacagtgaactttgtagagcagtgattcccaattctgagatgttgtaagaggaatgtcagaattcctaaaacactcatcctccaacctttcaaattcagtgctgtggtgagccattgttactgataagggtatatcccacttgtgatttctttgttttgggtcaagaaaagcttttgtagaagccagtgtaaaatggcatgcatataattaatttcctcatcttttcctcataaaatcagaggtccttttatcgatggtggtttgaaagtctggggtattcagatttggcagcagaaagtgtgttttttttgtgtgtgtgtgataaactaggtggattgctaattctgattgaggaattcgtaatgtttgacaccagaaccagagcacttgtgaaaagaagtctctttagtacaaaaccaaaaatttaattacagcatttgttataactatagccaataaaagtatttttaatgaaaaagaatttccgcagaagaaaatgctttctattaatgcagaaggtgttatatagaagatttaattgtaatgatattggttatgatccgttttttgttttatctttacctgtattttatattcgtataacctctaaattttacaaattacccataatacatttcttatataattaaaaaaattctgagtacagaacaggaaatatgttcaatctttattccattagagttctacttggaaagtattaatatgtaaggtttttatttctccataagaaatagacctatatagtcaggcacagtgtctcatgcctgtaatcccagtgctttgggaggctgaggcttgaggattgcttgaggccaggagtttgagaccaacctgggcaacacagcaagacctggtctctacaaaaaaattcttaaaaaatttagctgggtgtggtggcatgctcctgtggtcctacctacttaggaggctaaggtaggaggattcccttgagcccaggagttcgaggttacagtgacctatgattgtgccactgcactccagcctgagtgagagagtgagacattgtctccaaaaaaaaaaaaaaaaaaaaaaaaaaaaaagaaaagaaagataaatagatctatgtctagttaattcgaggagatggtacacatttttagagcacatgagaacgaagtttatacttttctgattttctgggtttccttgatgattttttggcaaatccttgtctgtttagctgtctggcatatgtatgactgtggttgggcttctttgtactcaaccaatgaatgcataccaactgtaacacctgaaggtaggatcatgaataaatactctgtgatttggggttagtatagttttggttgttttcccttctcctgagatttcagaaataaaagattcctattcctgtgatttttttggcacacagtaagacatatttgatacataagataagtcattataattaacttgtcgaatcactttttcttgctgcagaatgatatttttatgaatgccttaggttttttcaataaaaaatgcaaccaaactgcaaatgtactgtgatttaaagtggtaatgtcagaatttaaattttgagtagtactctttttttaaatcatagaatgctctatgtttattcaaaaaagtaaaatattattagacagtattttttattttaattttgcatttaaataaagttctcaagctcagactgaaaagtaaacactgtatgttggagcctgtctcaacgacacttaaaagctaagactttctactttttcagaagtacatttgtatcttttggcaaatgtgtagaaagcagcctgtcctaacaaattttgttcacctgttctcacttcagtttatagattgttaaacatttaatcataatatattttatatacaatatttatgtgaaaaatgcccatccttgattaaggggatttttttctactcttatttttattatttttaccagtatattctgaagtagagaaatgtgaaatgagatgaagatttaaattcctagcaaacagaatcatgcattgcccctgttttataagtaatgagatcattttgtagagtccagtttatttacatttgttaaatgatattaatatctcttccataagcatgaatttggtggtttgcatggtgttcactgaggtgaggatacttgtttaagtattttgaggatctcatactttcctagcagttctttttacttggttttctgaagtgaatatagtctttaaaaaaaagtataaggtactagtaatcagatactcatgatcacaaatgaaagtggtggagaaaccttttaaggaatattcacaaaagtgataattttccagattgtcaatgaggaaatgaaagtctctaataagctgtcacattaattgtgagctgcatttctcagtcagcaacaactaatagtcaatctataatagctccagcagagggaatgaaagtaatttagaaaaaagtttactatttgatttgtcaaagtgtgtccaggaagtaagagagcctaaccaaggggctgttgtgcatgtaagctcttcagtaaaagtggtggtgtactaagctatatttaagaaggtaatttgagattttatattacatgctagtgaatcatttttggattttgcaccagaactgagctctttggtccctgcctgtctgtggtttgtgttgcaaggtccagaggcttaaaacaaagaacaccatgggaaattctccatgagtcattccgtcagctgtagcttctgttttatagtccttcggatataactagtgttttaatgccagctctcctagccgcttttcatgctttggttctatatgctaataaaaaagtatggcagtatggctattgtagataacgttcagacttttttttctcccgattccacaatttttagttcttctaatggctctaagctagaccaattataaattgtaactggtgaaaagatttatgactgtttattttgttgtagttgcgaggtaagcgagtggtcacttaatacttttggttctgtgaatcttactgtccagagaactaaagattgaattagcagttcagctggagtcagcactatgtgctaaatccctatacttaagagctcttatgtattgcagacaaatgtcctcttagctgttttgttattttgtgaaaaataataataatagagcaaggcagtttagattcatatcagtttcaaattttaagtaccatgttttaagccattctaattgttttgtagaaacagataaattaaaaacttgatttaaatccagcccacaggatgccttaatcacctttgatattttaaaggagatgaggaaataatggacttttttgctagtaagtggcaggtatggtcaacacaatttcactacatttgaaaaaaatcactttccctgcttgccaggaaaatttaaagtgcagattgtaacctgatcttttttcttacagtgtaacgtctgagaagttcaagtattgacatgaattttctatgataccacttggtaaattaaatctgtggtttcatcactggctttgaattatatatttctatgcattttacttagctaaaaacttatttgaatatttagtctttaaatttattttttcttttctgcttatttgaatacatatcaccaacattcagattttatttttgtttttcttaatagtaaatacataagtggttactgcttgctaggcaatgcttcttattttctaatttaatccccaaaacaaatttgtgaggtataggtagatgtattagtaattatgttttagaggagatgcttaaagaggttaagcaacttgttcaagttcaaatacctgttaaattatgaaactagaatattaacccagttacatttgtttctgaggagtcttttgcccccaaggccttgaaattttagggaattttcatttatagcaatcaataatactattcccatcccaccctgtccatttctgattttcaatagtatagtttctgcactgatatttacatcgtcttacgatggttgagccttaaaattacctgcattgttgtctgatttgcaattctttgtctagtaactcttctcactggagtgggttccaataaaatggtgctgtatttcactcaaaatcaagttgcagtgttttttcctcctcattttaacatcactaaaatcagagtgtatctactaatggaattcttgataattctaaatttaataggtaacattctttgactgctaataaaatcttaaccactatccaatgtaagaaaaatttgtttaaccatctccccttcatttcaaccattccttattaagaagaaccaactacagtctcaaatgctcctttataactaagcccagggaagacatatctaacaccctagaggagagagaaaagggtatgaattaaggtttgagtgtgatatcagcatttcttctcatatggcttcagaacacttctcactgaagtattgtcaaaaggctctttatgcactgaaatcaataaaagaaaaaaacaatttctagcaggctatttattataagcaaatatgtgacgacacaaaactttctggtcctttgcaattttttaagtccaaaagaaattctgtttaacaatattaaaggactattccagttacaaaattgtgtgtttgtgtatgcttattagaataattaaacttggttaaaatgtaagtcttactctagtatacattatttattgggtaagtgttatttaactaccaaatcacatttccctctacactgtaataacacatcgggaagggccacctagggctttaaaattagaactcagaatttaacaaggaaaaggtattctgagttgagtgaataaatgtattctgaacgtttaaggcctttggttaagatttctaaaatgtagctgtgcttaatatacaaaatcaaaagtaaaggcaggccaggcgcggcggctcacacctgtaatcccagcactttgggaggccaaggcaggctgatcacttgaggtcgggagttcaagatcagcctggccaacatggcgaaaccccgtctctactaaaaatacaaaaattagctgggcatggtggcacgcagctgtaaccccagctactcgggaggctgaggcaggagaagtgtttgaacccgggaggtggaggttacagtgagctgagatttcaccactgcactccagcctgggtgacaaagcgagacttaatcgaaaaaagaaaaggaaaaaaaaaaaaggcatctagccaccatatcccagtgattcaaattcctgataattctttgctttattaatcatcgttcttcattttggaatttgacttttttgctatctgttaatagaaaaatacacacacacacatataagtaaacacagtatattcattgttgaccaagtgtccaagttatcaatatgatattttcaaaaaccaggcacagtttcattaggcacctgtaacattatgtcatagtcacatacagctgttctacataatatcgatccaaaagatattgtcatgatttcatgattagactacacagtggacagggacttaaaaatataggagttttgttcaccagaatgtatttcatcagactaatggttgaactgatttgttgcttatgacctggccactttgtagctttcagacctgcctttctgtagcagttgatagtatggattatctgatcttccttcccttctgggacaggcttttctcttttctaattcattttcttaatctcctacctccattctcaatcatgcagatgctagtttctcccccatatttgagcctgagcattttttcaagtttccttggtgttttacatttcagtgaccatcagtaggttgataactcaaatctgcaactttagccccaggctttctttgaggttctagctttctatttccagctctctgattacatctgtctcaatattcagcatgtggtagggattttgcaaaactatgggattatcttggtgactttcctagctgaagcagagagaactaatgaaatagccaagaaggttcttgacattgttacttatgcatataagcatatatatacacacatatgtacacatatatttatttgctttagcagatactttaaagtagaattcaatgattagagaaaaaattatgattttaatattatttgagacgttcttaatctatacttgaagtagtaagtagattatgataagcaagttggactgtgggcgtggtccttgttcattttctcattccgtttttgtccccatttttcctctcctttttcattaccttgtaagagaaaatagctcaggaaacgggtttacaatcagtagtctgggaacttccgggattctttaccagcatccccctggatgttgcagtccctgacgcaagcagcattgttttagggtaggagtttttataatggctgtgaggtcgagtgcctaaggttgataaatggcagttgttatcctttgcagaaactcagttggaatcctttctgtcaacttgtatgttcatctgtaaattaagaaacatgttcccattccctccctctcctacctcaacagttatggacagactgcttaggaactcctatttctgaagatttcgtggtcttttgtaaagtcagtttgttctctagagcagtgtcatcttgtcccagaaccccctttacttactaccactacttctttgtaagttaacatgctatcactgattaggaaaggttttagattcttagtctttttctatggatcaattttggtttaaataggtgtcgaagggaattgtaagtcagcttgtattttggaggttttgtttctacctccatgccaaatgaaatgtagtcattgaagtatcattgtattatgtttatttctgtctttactaataggcttttttaaaaccctagttttactgatgttcttaataaagtacggttcctattactaaataatctttacataaaatgccataggttgaaataatttaaaagacagaaatcaaaatgtaggatgatatttgagaagacttagattagcatttatatatagcatcaaacgcttatcaagaagcttccggcagtattcatttaaaagagagagaaccaggaggaaatgctgtagttctttcagcttataggacccccccagaaaaacaaaacaggaaagtgccctttgttttctacttttggaaggtattttttgtaaccgataattactttaatgttaatttttttctagataatctgttattaaatctaaacctaataattgaggatcacgatgacatagatcaatagtgcagtaatcaacacccagatattttgggaagtagtgtgaagtgatgggaaggaaggaactttcccttctaggaaaacagtgagaataatattttaatggcaaaatatttctttttgtcttgatttttaaaaatctataaaatggaaagtatatctcttcatagagatttctttttttcaagattaaacgagataatacatgtggaaataatgcatagcatttggtaagccctttataaatttagcaattgctcttattattgggatttttaaaaagaaaagctatattctaggacagctgatggtaaatgcactggcagtttaagatttaacaaagtagttaagatacttaaacatggtgttcaacttcttattcctccagcttattgattcttgctattggaaagttaccataagatttaaatctcttattctggttcagtaggatgaataaatttagtaacaaaatcttacaagtaaagtaactacatctatccttattttttctttgtttcaggtttcccctcaaaaaacctataaggtaagtttgctcaattacacttcatactcaagtttaggttatattttaattataagcatccctttgaaattatggtggatttttgtggtttttgagaatgtgtattcaagtaattcaaaatttcaaaatgttttacaaatttaaaatgtaaaagatgttactttttctggaagacagcattgttttgataatacttctaatataagcatttaaaaattttgttcaaaaggatatttaaggtcacactgaagagacttaattttgaagtctatttgtgactgttttgaattatgagtagcttaggaggtgaaaatagaatgctagtttttgatgtgttttatcacttgtgtgactataattgcctttagttaatgtactttggtactagtttagtcttaattactttattttttattttattttattttattttttgagatgggatctcactctgttgcccagcctggagtgcagtggcgcgatctcagctcactgcaagcaccgcctcccgggttcacaccattctcctgcctcagcctcccgagtagctgggactacaggcgcccgccaccacgcctggctaattttttgtatttttagtagagacggagtttcactgtgttagccaggatggtctggatctcctgacctcgtgattcgcccgcctcaggctccgaaagtgctgggattacaggcgtaagccactgcacccagcctagtcttaattactttaagacagtgaagaaaaaaatccaaaatgttaaaatgtatctatgcctatatccatgtctatatatttattcatttccaggtcttaaatgcctcttcctcagtatttttgctttcagcatttcttctgttatcttatcataaatattatttaaaatgtaggtagtatgtcattcctaattattatattttatcatttttagtgtcagcatagtccaggatccaatgctaaccttggcatttcagtgaatatgtgtatgtgtacatatgtattattgttatggtcttgtcacccaaccattatctgatcagtgtaattggctaagccatagaagtaataataataataatgtcattggtccttaaagtggttggctaagacttctgtggctagaactacatcagcaggcttaaaatgaggcttgcctaaggctgctttttaaatgttaaaccgttctcatgcatgctctatttatgcagtgattttgaacttgatcatagtatatgtagagttggagaatgggtttaattccttttaggcactgtgttttttttgtctgttaaatggaaatgatagtattgacctgtgaaaaccacacaaaaaaaatgtaagcagttacttctgagaataaaagagactttaatgctgaatactatttttaattattttaagcagtttttataatcaagtaaatagactgtgtataaccaaaacttattgaaaaatgtaaattagagaggcttatggtgctgtgtaaagtaaactgatttcctggtttttcttgtaagatccacttttagaattttaaattttttattctaatgattttcttgcactaagcatttgattactttgctttaatttaggcatggaagtattttgaaccgagagtcaccaacagataagaagcagaaagttgagcgcattgcatcacatgattttgaccccacaggtaaaacactattcattctttcaaagagtattgagagtagtgaagttcagaataatagagcttaagctacccgaaacactcaggaatagttgtttgatctgttttaggactctcacattcctccaattatatcataataaagcctttgcatttagtaggaatgcaagcatttttaacttccaacactgtacattccactacagaagtatcattgtagagtatattgtatctttaaatagtgataataatagaaatggttatataataattggagatttggtcagatcaagaactcagtgttaagttgaatcatggtataagcagtaatatgtcataaaaccaaggctctaacaactcgacacttgcgtagtcatctaaaaattcaattgtgattatggtgaattggagttttagataaatcagtttcacaaattaatgatggtctcattttagagtaaacaaatgaatagaaatccctttctcttcagtcaaaaagtattctgaacttaaagagctgtctttcaacctaagcagtgtcgatctttcctagggttgtcaccttaacagactttcagattgatctccttttaaaacatctaggctttttccttttgctttctccttgtaagcttactccatatttgattcatagaaagtgcttggtaatcttgcttttttcatttgaaactgatatatattttttgtgcacatactattttattcagttgcctgtccctttgacaagagacgaagtaaatcccgctatctcagatacataaaaataatgtatctatttttaggtatttttacttagaaatataattttaaatatttaatagagaatagtatgttttatttatctaagacatttcatactttattagtataaactcctttattttgaaaaaatattataaatattatctaggaagcacatagataatcattttctgcattttgggtagtaggtaaaatgaaattccaatcatcaatttaggaggctttggtggtgggactatgtattatgtcacttacagatctccatgaagagagaattttccattctgatgcctaattttgtagtcatggggctcagaggctttcatttacatgattaggtattgtcttgccaataaggtcaaaagtttctgccctatgttcagaaaaatataatcttgttaggtttattttgtatctacatctgtgctgtgcccatctccaaagacagatttaagcaaagatgtatacaatgcttcataatgagatcattatagcttttagtgcttttgtcatctctacaattatcaggtgatatattttgtatactattcatgtgttgttttgtttgaacatatttttattgcactgtcttttcttcgataaatctttaaaatatgtcattacctgtgctgtttgtgactattctaagtgctgtcatctgttatgttcatactttgtgtttgcacgatttaacttgatcatgattcattcttttttccccatgaatttttccccttacattgtctccatattttctatatctctctccttttctcccgctcttgtgcagatagctcctccaagaagacaaagtctagttcagaggagagtagatccgagatatatggtaagctaatgtagctaattcagccttgccctttggagcttgcttcatggtgttccttttctgttctttttttcctttctttctttctttttaaataactgcagcctttcttgtgtctgctgtgcatggcatgatctactgcagggaaagggagcctggggttttaacgtggctgtgatgtggaagcttaaggttgctagaaactaacattgtagattaagagtaggccacattgcccatcttctcccgtcttgtttatggtaggaaggtgattatctctaatatgtttgggtcaggttcctccaaataacatgaatgggctttgaattcttgtcatcttcttcccacatctcatttgcagagtttggattatgaagaatttgaggaattaagtcttttcctctaagtataatactggtgtaatttagacgtattagcagttctttggaatttttatttcattttttgtttgtttatttttaattgcctcgtcatgtggaaaagtcattcttgtataatttatccacgatggcaaaaatacgtaagtattttatcttcatagcttgaagaatttgtgcctttgagaagtttctctgaagcttaatcggaatgggaaaatttcagaatggtaccttttaaataatcttaacaaagagcaagtttaacctgagtggtcaacttttgcagcagatgattgaaatgctaatatttctagactgtgtcctgtcttccaaagatacaataaccatgtttgtgaagttcatacctatttttccttttcctttgcagttttatttgccctctttccttcttttggagtctgattagggttttgttttggggtttttttttttttggttttttgttttttgagaaaagtgaataagagaggaattacctggagctaagattttaaaaataatttctgaaagactgataaattatttctttttttaggaagattccaaatttggcctcgaagggaaatcaggtcatctttaatagagccacaaatctatagagcagaagctcccccaggtgcagatagatgtttcctagcttgatatataggagaggaaaaaatacaggaattgccctcccctttttaagacatttgataattcacatctgctggcacttgagcccatatcagatactttttagtattatgaaagctcagtgtttggttctaaaccagttaattcttctatgttagatatatacacatagttctttacttgggtttttgtgaccagtgctttttctgtgtataccttttacagtagttcagcagtaaatgtatactgtgccttgtgacacatcaagtttacgctttttcttccttccagagtattttggctactgataagtaagaactacctaattcctggagactatatttctgttctatataaagagctttctatagtttatcctctccttaggaacatgaacattatctttatagctctattctttttcggtagcctttgcagtgttctatttcgtcttcctctccattttcctagatctgcgatgtgtatttagaagcttgttgtatgctttggatgaagactaacaatttaggaacctctgactagaaatactatactaatatttttcttagcagtgatagaaacattaatactagttcaggcatgccattggcttggtagtgatagaaacattttaagtggtaattgggaagtaaggtgtggcttctctgtgtgtttgttttttgagaacccttgaaataccttttttggaaggaactgagtccacaagtcctcaaaaagcactcatcggagggatgagttgattagaacagaattagcatgctaacgtaaatctctttgacattacaaatattttatcacctgtgtgaatagacgtctttagattacgtacagttagcatagatgaaaaagtctctctggggattcagaaaagcttgaaactactgagtagaatcatagcaactggtgacattctgctttagtgtagggtcttattataagcccacttcaaactttagagattatacattgctttctcggggtaaaattcattagctgagtacttaacaaaaatgctagttactcacatattatttattttaaactttcttggcttttttttttttttttttttttttttgagacaagatctcgctgtgtggcccaggatggagtataatggcgggatcatgactcactgcagcctcaacctcctgggctcaagtgatcctcctacctaagactccaaagtagctgggactacaggtgcacaccactgcacccagctgttttgtttgtttgtttgtttttttaatagagatgaggttgttgaaggaatgatttgccaggggaaaaaaaaaaaagaaagaaatagtagagacaaagtctcgccatgttgcccaggctgatctctgtctcctgagctcaagcagtcctcccaaaatgctgggattaaaggcataagccaccgcacctggcttcttagccatttttagagctactttgtgaactagatttactttgtgcatcttaaaaggaaaccaagtgtttgctttgtattgactttttttgttacatttctgcccagtgcggtcagttggttatttattccatttccccttatttgtccctttctacctgttagagtctattaaacgtgtatggatgcgttttctgatctacaattttaataatacttaattttattaatacttttgtgggttactgtaggaaatgagagattcagcaagggaattctgagttagaccatagctgctgcttaaccgctgtcatggtgtctgaacagattcctgctaacagtatttggttcaagaaaataagttatgtctttttaaagctgtcttagtgtgttcaggccactgtaacaaaataccatagactgcttggtttaagcaatagaaacttattttctcacagttctggaggttagaagatcaagatcaggatgtcagtgtgatcaggtcagaagattcccttgctggcttgcagatggctgccttcttgctgtttgtctcacatggcctttcctccgtgtttgccaatgccctttctttagtttctatgatattacatcaacctggttctttattctttgtaattattttgtctctctttatttgattgttttttccctcctgttttatacatgtaggcatgacccaagtttctgtccccaatctttcttccagtctccagtctaagtgtcccataaattcagagtgaccaaactggagttcatcattgttctctacagctggaaatcagtcttcctctttatttccctaattcttataatgacactgtcatttttccactcacctagtcttatatttccttaaagttatatttgacttctccattttccgtcgtcccctgtggtcagctatttgccaggtccccttgattctaccatcacaatatttttcatccttcactctttggtttcaaccccactgccttgtccatcattttattagactattataatagattcgtaacttacttttatttcagtttcacattgattcattaacttttctccattctatattctgccttgacttgtcagattaatattactaaagtaagaatttggtcattcacttgctaagaaagtacaggtagttattaagataatgccacaatttgtttccaatttattctactctgattctccttcagcgtttcattttccaaaacatgttttggcattcttcctttgcacatgccatttctgttgtcttgagtgaattaccacctataacttagaatcctactcatctttcaaggcttaattcaagtactgccttttcctaggattgcccagctacttttgttgtttctgaatgttgacatctgttttgtatttaattacttatatttatgtttatctttacatctcccataatgctgaacatattggagacactcattaagtgagttttgaatgaatgattgttgagattgacataggaagtattttagtagagaaaattgatggaataagatcttcactcatcctaattgaatctttctttccttctgaaaaacttgaagatagaagaaaatgtaacttggagacatttttctggtagtggtctgaaagaatgaaatcagcatacttggaatttaaggctcttcttgctggcaagactgtgcatttagaatcaagaagcttcttaatcaaaggattatctgaggtcttactcataaaacatgtatgtctggcaccagtttaaaatgagctgtttttatgaggttgcacatggcccttctccactcccttccctgaagctgattcttaagagctgaaacctagagaagtttggtcatgaaataaaataaaaggtgaagaaagactaatgtgctttcactaaagtcaatgtaatatggaagatttaacaggttatcttacatgtttaacactccattttcattaatatgccccacaccctattttcattataggagttatggccttctttcaggaacagttatagaatgacacttcatttttttttcactttcaaaatatgatcattggtaattatctattgagtaagaaggaagcagtctttttatgttggttttaagtgccacattgtaataacagaaaaaatatgtcttttgttatgataaggaaataaaagaaatggatagtatttatgtaaatttgatataacatctttacttcactgatgagatgaagcatgatatcaggtttatcagcttctaggcaaaatatgatttttaagagacaggaaataaagtttgttttgtaactagaggagttattttggggtagatggaaaaatcaaattattatagttggaattttgccagggcagaaggttaattagcgttcttatagaaatgttcctctactttgcatagtcttcaaggctgtgattttttttctaattagaaaatgtttgagtattttatttaaaatttcctttgtgtataaaattcaaatttatttaataactatttagtgagcacccattacatgccaggcactatactaaggcatagagatacaaagatataagtgactctacctactttctggttgttcacagtctggtacaaaagaattgcaatacattttgataagtgcagtgatagagatatgcactcatttaccattactctatatgcacttaaaaaaacagctgtgaagaaatactcatatggcaccaagaacaatgggacggaagaagtattactaggactaagtcttttgtttttttgaaaaacgtgtttattattactgttattttttgtagagaagaggtcttgctaagttgcccaggctgtgctcaaactcctggcctcaaccagtcctcttgccttggcctcccaaaacgttgggattacaggtgtgatccacggtgcctgcctgtcaggattacgtttgaaggaagtttaactttttataccagtctcactggttttactttttgaacactctgcctgtgtctatgcaaagtgctggcatatagcacatatcaaagtaattaggtggccttacagaactcatattcacagatagatacatttgtatggaagttatgattaataatctttataccagatgataaaggatttagcaacaaaacaaaaccatggactatatgagttgtagaaatcagaaaaagtaaaagtgatgaaagctggtttttgggtttttttttaattaatgaaatttgaagattgctattttggagttatgagtctacttttatctttggctttctctgtaacatacagggcctattttctgtaccattttctgattcttaaacattgtcatttttttctccatttgttttcagtattgtcctgccaggattttatgttctttgagaacagaaactccaagtagtcttgggttcttcacagcacctatgaactgcagtgttaaataactagtatggacagatgctcaatgcaaatttgctaaaacaaacaaaagaagtaggatttttgtgtgtgtatgtcaaaaaggatagtacaaagatatgataatgtagccagtattggtgattttagttctacagagggtggaatttttccctctgtggtaggttaaaacagcttctggtcaacaaatagaatatttctctgaagaaaaagggaaaacatttcatttgattttgaatgagagggaacataatagatttgagcatttgaaggactggatttctgaattttgaatggtaggatggcttcgttttcagttaattattaccacagatctaaatttatgcagacaccacagatagacaggacagaatagtattgttaatttgaattttatagattctgaattgactgtatgtgtaacactttttatattggtctactgatttaaagtacatgttaaagtacatcaatctcacattagcaggtaaatataaaataataaatgtggctaatacagtggatttggggagaagaaaaaattgaataggatgtgtgcatagttctttttccttttcctctttattctttgtccctcatctccttttgctgtagaattaagagggaaggttatcagactgagactgttatgaattggagataagagatttgctgtattctgaagtaatactaataggttttcttgattcttattaatctgttaggattctaggcatatttataaaattgactgtgcatggtgctgtttttttctctccgatgacctccctttctgagcttcctttcatctctagacttgtctacttgtctgaatttcattaattcataagcaatttttttaagtttccttctgtcccagaatacatgcaaggttctgagataagattgtgatgaagatacagcccctgcacctttggagcataaaatccaatgaaagaataaaaacaaatacaaatcagtgtgagtaagggtgatacagtaggagtacacagagggtgcagtgggagtctgtaagaggggcacctaacttcagtatgcatatttaggaaaagcttgtaagaagactgattcttttcttaaggacgtccagctgtctctcatcttctaaagctgcctataacaagaagctctgcccttttaaatttcccttctgtcttccttacccatccaaaactactttccttgtttgctaaaaaacaaaacttagacataaatcataattgatcctcttttttttttgagatggagtctttgttgccaggctggagtgcagtggcgcgatctcggctcactgcatcctctgcctcctgggttcaagcgattctcctgcctcagcctcctgagtagcctgggactacaggcacgcgccaccacgcacagctagtttttgtatttttagtagggacagggtttcaccatgttggccaggatggtctcaatctcttgacttcgtgatccgcccatctcagccttccaaatgcgcccagccagaattgattctcttaaggatcatttgcattaattgataggagtttattaacataaaagtacttacaattgtactagtagcatggatagaggagaaaatccaaggtcaacctccccttaatcataataaaataatatttaacgtgtaggaacccttaatatttgttagacattaagctaactactttatatatttttttattcaagtgagaggtgcaaacatagcaaactccttgactccaaatacccgtttccctcatgttttacaggtgtcctgttctctgcaggcatctgaaaaaaggtctatttaagaagcccaggttgcttagcactgcagtcacccatattagaaacctttaattcattaattttcagcttttgtgaggtgaggtgggagaatggagaagcacgaatatagtatgaaaaaacgtattcagtgttataattgccttgatttctaaagtcacagtatctaatttattttgaaatttcaaataactataagggaggttgtgaaatatttgtttccaaaagcaagcatggattttaaaaggttcctgtaaaatgctgcttagtctaataattttttttttttttttttttgagatggagtctctcactctgtcacccaggctaggctggagtgcagtggtgcagtctcggctcactgcaacctccagctcccagattcaagcagttctcctgcctcagcctcccaagtagctgagattacaggtacctaccaccatgccaggctgattttgttttatcatgttggtcaggctggtctcactcctgacttcattcaggtgatccacctgtctcagcctaccaaagtgctgagattacaggcatgagccaccatgcctggccagaatctctgattctatttattatatgctagaatttataaagaatgctttttttaaacttgatttatatattcatatcctattttataggtgtcctaattacttgaaggaagtaacactgaacagataacaaaggttgaattctaatgtgttatcacctgacctcattacaatttattgttttgtgagagtggtgaatatgttatttagtatttagaagtctctagaatttaggggtaacacatttttaaatgttgaaaatcaactttattgaggtaaaatttacataaaataagatgcactaattgtaagtgtatggttagaaaattttgacaaatgactatgcatactcatgtaaacattatcttaagaaacagaacatttccatcactgcagaaagttccttcatttcattttgcagtcattcccactcctcttccgtgcttctcccctaggcagttgctattctgctttttgttgttttagtttagtttttccttttctatgttggagtcatgtagtgtttactttcttacatactggtttcttttgcttaccatgatgtttttatgtttcatccatgtttgttgtatgagtagtccttttcttccttcctaatacattgtatggacatacgacagtttgtttatccattcatccgttgatagacatttgagtttctagttttgggctcttatgaataaaactgctgtgaacatttgtgtatgtctttctgtggacacaaattgttctttctcttcagagtaaaattaatggatcatatgcaaatatatgcttacctttataagaaatttccaaacagttttccagaatgttagcacattcccaccagcaatgttataatgttctaagagttctagttgctccacctctttgctaccactgtttatgattagccagactagttggtgtatagtggtatctcattgtggttttaatttgtattttcctgacgactgcagctgttaagcacctttacatgtgcttattggccattggtctatctttgtaatgtgtttatttaagtattttgccccctttaacatttgtcttccattattggctggagagttgcatataatctggatacaaattctttatcagatatccatattgtgaatattttctctgtggtttgccttttcattttctttttctttttctttctttttttttgtgacagagtctcgctctgtcgcccaggctggacccgcctcccaggttggacccgcctcccaggttcacgccattcttctgcctcagcctcccgagtagctgggactacaggcacccgccaccacgttcggctaatttttttgtatttttagtagagacagggtttcactgtgttagccaggatggtctcgatctcctgacctcatgatccgcccttctcggcctcccaaagtgctgcgattacaggcccggcctgccttttcattttcttaccagtgtctttagaatagcaaatgttttaaatttttgtccagtttcctaggttttttttcttttatggtttataaacccaccctaaggtctttttttaatgttataaaatattttgttacatgtattttatctgttttctttttctttctttcttccttttttgtttttttaataccctaaggtcttgacgatttccttttgtgttatcttatgaaaaattttagcttatgtttaggcccatgatctgctttaatttttgtgtaggtcatgagttcaagggttaaggttcatgttaagctacagtaggctcatgtactcatgatgtgtcattatcagcaaaaatagatatgtatatacactgtgtgtatatatatataatttgttatatgtatatgttttctatgagccattgtacacacagtctatatatattttttattaacatatctttagcatatcgtttggttggtaaatcagacttatatttaaaagattgtggctttttgtataaaaatctttagaaaaagtttttattttctattcattatctttgtgttgttttacctgttttatatattgacttcggtgaaatgcttagatcctgcaaagctgaaaatatatgttgtctctggctaacacagagttcaagatcttcagatctggtctatgataaaacagccctgggtactaatcagggttctaccctggcaggacatttctattcctctggctggggccctctttctctcaccttgccctgacagttttcatttgctgtttagaagaaacacaaattctcccttaggaatcaggtaagtatatgaaagagatgaaggaactggttgagctcacagattctttatcttttctatttttttctcttttctgtttctgttttctataagccagggtttttcttccccctgaactcttcctttctcttcccttctttggggaataacttcaggtactctgtaagcacctcctttctttttactgttttcctgagtatattttcttgagagtgagactggatttctgcagaattttccttgagatgctcctagccccatgtcctaagatggttgatttttcttgggttaaacaccaattagggtaccaaaaactcagggcagtggggcagggggagaatttttttactacagagaaatagcatggatgtgaatgggctttccttctagctgtctcatgtctaatacttaatattttgcagtttgccatagctgtttttaatattggagcaattctattatactccgccagtgagaaaacagtatgtgtgactctgtggtgttcttgtgtttgctttgttgatggtggttagtgttcttattttaccatgtggatttacatgtgctactttttgtttctccagatggaacacagtttattactaatatataattattgtcttttcctttctctgttttctcttccttcttgttttacactgtggttcttgtgcaggtcttgttcagcgttgcgtaatcatccagaaagatgacaatggatttgggctgacggtcagtggagacaatccagtcttcgtacagtctgtcaaagaaggcaaggcattttaaaaaacaatttatcactcagtaaacagagtaagaatagaaaagcttaaataatggcaattgccaagaatagaataattacatagattgcaggtcatgtggactattgtgctagattcgtctatcatgtcatagttacaggaaggagtttactccagttgatttttttttgtacttgttagaaagaaatcagtttttatttagttttagaaatcatgtgactccttggtcatgatactttattgtccacacaaaagtttctgaaatttcagttttccatggcaccactgatattttggcaaagacagattaaagagatagctatggcttcagaaataccatttattttcccaaaacaacagtgataatattttctactgctgttaccatatattgaatacttcctttatgttgggtgctataattttgaggtagacaatttttttatccccattttataggtgatattgaggcttagagtaaagaaacatcaaatcagtccaaggtcacacaactagtgagtggcagaagcagcatttgaatgtaaagtctgactttacagccttgttttttttttttgtttttttttttttggagatggagtctccctctgtcaccagactggagtgcagtggcacaatctaggctcactgcaacctctgcctcctgggttaaagcgactctcctgcctcagcctgccgagcagctgggactacaggcacgtgccaccacacccagtgaatttttgtatttttagtagagacggggttttaccatgttggccaggatggtctcgatctcttgacctcgtgatccgcccgcctcggcctcccaaaggacagcccatgtttttaaccagtttgttatactgtctctctgtcaggaagatgatcagtaaatgcaaatgaatcacattttaagcaattaatttctcatacagatggagcagccatgcgggctggagtacagacaggtgatcgaatcatcaaggtaaggaataggctattatagaatttacggtaggattaaaaaacaacatatattggtcatattctgatttttttcacttggatttttataaaaagcatcatacttctatgtatgatagatctgttgactatacaaacttatttcatttgttttaaaattaatactaccctttactgaaggacgtaataaaaggattgaaaataatggaggaatatatgttcttgagtaggagagtaattcagggttggaaagatcatttctgtctagattagtctgttattaagcaattctcatcaaagtacaagttgaacatttctaatctgacacctgaaatgctcccaactctgcaagtttttgagtaccaacatgacaccatgaatggaaaatttcacacctgacctcatgtgatgggtcacagtcaaaagttggtttcaccaggtacagtagcttgagcctgtattaccagctactcaggaggctgaggtgggaggattgcttgagtgcaggagctgagactgcagtgcactttgatcatacctgagaatagccacagcacttcaacctgggcaatatagtgagaccctgtctttacaaaacaaataaaaccaaaccaaaacaaaaaacttggttccatgcacaaaagtatttaaaatgtataaaactaccttcaggctatgtgtataaggtatatatgaaacataaaaggctcatatttaaacctgggtctgatccccaagatgtatcattatgtatatacaaatattccaaacttcaaaaaaatccaaaacacttcttctggtaccaggtatttcagataagcgatacctgacctgtatgcaaatagaattgtagtggtagatgtctatctgattattcttccagatgaactttataaagatataagaatcactaaagataaaaacatgttatatgtatgtgtatgtatgagaagagatgtatatgactctaatctagatatagacctaccagtggaacacaacagagagactagaaatagattttgaattcagatcagtagagaaagaatgggttagttagtaactattctttaaataattgactaatttgattacttaaaatcaaattattacataagaaaacataccatgaaaaataatttggaagaaatatctgaaacgtatcacagaccagatatccttaaatttaaagaacacttttaaattataagaaaggaataaatattctaaaagaaaaatgggcaaagaattttatcaggcagttccctaaagtaactgaaatacataacatattaatgaggatatggccaacctcactgataacaaagaagaagaaattaaaatgataggtgaaaaatacatttggctgtcagaaaatttaaagattggtaatacacatttagtatagtttgggtatggtaaaatgactattctcatgagttcgttgtgagtataaattaggtaaaacctgtttggatgaaagtctgtgaatatgtatcaaaagcctttaagaaagtatataacatgtgacaagcaattttgcttttaggaacttatctgaggaaataagtgtacaaatgtgaagtcgtgtgtacagggaaatttgtactggctttattacataactgtgcataaactgagggacagagaaataaattatattccatttgcagcttttgaaaagaatggattaggtcagtgtgtatctttattgaaagatagctgccgtacagtgaaaaaaaagttttattttttttttccaggaaaaagccagtcgtaatgtataatgtttatgtgtctctttggtgtgtgtatactagaaaagtgtctccaaaattaaatgtcatagctaacagtaactgcctcatggggcaggatgagtatacttgtacttctgttttttacactgatatatttgtattttagataacttggatcagagaattaatcagaaaattaatgttaaatccacatttgatagttttgccttgatttgtttggtttaattcagaatcgggataacattttctacatttagccggtctgaaaattaattttctttgtgaagattagatcatggttgaaaaactaaaagcaaattgaatattgtggaaatacttattttaaaaattattttttattattaattttgacaaattgatgacttggtaattaaaagcaaagagatcttttctatttgtatgagcccttcaccgtgaacgatttgtaaatctgtttcatgttatgttttgtcatttgtcatggtgaataagttgtactgttttgtatgtcaaggcctcggtttatgtttaagttcattttgttgctgaatatgccctgtagaatcatggtgtgaaaatgaatattgaatcaaatacataaatattttaatgtaatgtgattactatattatattggttatattatgtatgataattcttgaagtcattttatccattgtctcaatagaatgtatctgacatacactactttcgttttcttacaggtgaatggaactctggtgactcattcaaatcatctggaggtggtgaagctaatcaaatgtaggtgaatgttattcttagttttaattgttttctgaaacccttaaagtaaggagcagcaaatttcctgtaataggccaaatagtaaatatttaggctatgtggactatatagtctactgccgactctgtcattgtatcatgaaagcagccatagactatatgtaaatgaatgggtgtggctgagcttcagtaaaactttatttgccaaaagtctgtgatcctggtttagccccttggctggagtttgctgatccctgcattgaaggaaaatctgaggtgaaaactcttagcttactaatagctatcttttgtcaactccatttatatggttgattataatattcctgtcattcttggtaatatttgatacatatatttgaaagaaatgcatgagtcacctgagaggaaggaggttgagaagtcagacatatggcctgatgaactgaaatggaactttaaaaatcatctagcacaatcactttccctcagataagtaaatgattatataatccagagtagcgatcttctcttggaaatctttagggttaagaatttgtgatcttcaggtttgagtgaatagcccacttggacttagttctctgtggagaaacaggcttgaagcagtgggagtctgcagctaacctcccgtcacttgcagggtcaaaggtggattcacgaacctcgagctggcagtgagttatgggcaagccaggcctcagccactcacagggcctcagttttcccatctgcacagggagaagggaaggttcagtggccctgtgagctttgctagcaggtggtgatggggtgggtcatctgaatctgagtcaggtggaatcttccccaacctgggctttggtttcattttgttgttatcctttaaccttacctgctttccaagagagattttatgttttcttggttttttttttttttttgtttgtttgtttttagggtagggtcttgtagaatgcaatggtgcaattatagctcactacagcctccaacttctgggttcaagtgatcctcccaccttgttttttgttttttgttttgtcttgtttttttggtagagacagggttttgctgtgttccccaggctgctgtcaaactcctgggctcacccatctcagcctcctaaagcgctgggattacaggcacgagccactatacctggccaagattttatattttctaattgcttcacatactgaatggaaaatagcatgacagttataacagaagtaaagaaagtcacatgagagtccaccacctaaaatataacttcctttttctttgttctggcctggtttgggccgtatgtatttgttattgtatctcttaaaaaaaaaaaaaaaaagagagagactgcttgaactgaatgaaatttttttaaaaaaggaattaaaaaaagaatttatgatcttctgcatcagattattccacagtaaagtagactagaaataagagatagttgtttgtgatcaatcagaatcactactgttttatttaattctgtttctctgtattgggtggatggacatcttcaaaagaaatttaataaactaacttttttcttggcctttttactgctatgttaagcaactatgaaattttttaaactttttcatcagagtaccagtgctccaaatggtcactttgatcagcgttctttagtttaaaagagtgcagtgatcaaaattagatccccatacttgaataaacttgaccacttatttaatgagaatgtgatttataaattgttatgtgctgcataaatatggtttatgttaatgagtttatgcctgatgtccattgaggtgtataaaaacatttctttagctttctaggttatattttttgctcattccagtataaattttacttaaaaaattaaatcctgggattctagcaataaattacttacccaatagtaagggcatagctaaaaacttaaagtaaagcataaaaacctctgcatatccaaaactgatgtaaatttgacatcacatctgtaaagcctgggtgtatgtaacagagttcctgcatgtcctactttctaatgtgtattctggatataataaaagtgatatcaaatcagagcagtttagaaacagctaaagaaaggaagggaaaagctaggaagctattaaaaccaaatacataggcaagtgagatataatagatgactttctgatagagagcaataagattgaagagccttagaaagtgtttatatgtaaaattcctccaaattataacacttgtgagtattatacatagcaaaactagtttttagaacaccaaaacactgtgaaataattgataatgatttccatgggagggttaaattgggagacaagtgtgaaatacatttaaaagttctattgaaatatctaagaaaaaagttttgccatatctattactgactctgattatggtgtttttttttgtttttgtttttgtttttgttttttgagacgaattcttgttctgtcacccaggctggcgtgcagtggcgcaatctcggctcactgcaacctccgcctcccaggttcaagtgattctcctgcctcagcttccctagtagctgagactacaggcatgtgccaccacgcccggctaattttttgtatttttagtagagactgggtttcaccatgttagcaaggctggtcttgatctcctgaacttgtgatctgcctgcctcagcctcccaaagtgctgagattacaggcatgagccaccatgcctggcctgattatggtgatttttgctgtctagattcccgccccccgcaatatgtctactgaattcctgtccattcctccaaatattttctactaaaatttactacttattattgattgtgtttttccctgttattgtggaatattttttggtcatactcattttgtaaagttaatttaaaattgcattttatgttctagcatattcactaaaccctgcctagttagtgtcatcttaaaatatgaagatctaggccaggtgctgtgtctcacacctctaatcctagcaccttgggaggccaaggcgggtggatcgcttgagctcaggagtttaagaccagcctgggcaacatggcgaaaccctatctttaaaaaaaaaaaacattgcagctacttgtgggggctgaggagggaggattgcttgaacccaggaagtcgaggctgcagtgagctgagatcgtgccgcggcactccagcctgggtgacaaagtgagaccctaattaaaaaaaaaaaagaagatttaaaaaatttacatttaagaaattaattaaacatagccactaatagatggttgattttaacactcctctaaataaagaaaatatataatatattcttggagttataaattttatttgcttttaagtaatatctgatcttactagtagtaacttgctatctgaaaacggcatcattcttttggatttttagggcagtcataaaagagaaatgacaaattagtttttttttctgtggagacatgatgtagcagatgatgggactgtcttacataactggatcttttagaactatcgaagattaagtagtaaaatggtataaaaagtttcttgacaatgttattttcccttcccttccctttttccgtctccccaccccaagctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggtaagaatggggaaatttcttagttaaatgctcagtcttataaggatgtgtttactttatatggagagttttcaagtattcggctgatgaactaattaaatttaagattttagaaaatgatttactaatataaaaattacataataggaatgattagaatattgtcatagcagatttaatttaacaagtattagacacctgccatatgtaaaacagtgtgccacccacagaaatatagttaaggtactctatgttcaagattatagtcatcttagaatgtgtacttttaggagggcggggatttttgtttattttgtttactgttacgtttccagtacctgaaatattgcttagcatgtagaaggtgcttaacaaagctttgttgattgagattaagtcaagagtatacaagtaactataatacaaggcagaatgtagacattatgagggcaaaaaaaatgctaagttctatgaggattcaaaggagggagaaagcacatagaagaagaacaataaatagaaggagccaaaaaagcatcaaatattgtggagaagtagctaggatttttggttggttggtgcctgttaaggatgtgcatagtgggagatgaacttgaaaatagtaggttgactatatattttgaaaagtcacatctcccaagctaatttacatgtaactagataagcagtaagaatccattcaatgttgtttctttttaagcaaaagagtacatgattatcctaggattataggaagactaatttggtaaaatattatagggttgtgaaacaaggagggatgatgggtgatgaattagggagctgtcttcatatttcaggtaagaggtactgggagtttgagctatgcatggggatcgatagtaaagatccaaatgagggaaagtaaaagatactattcttatactaagacaacttcatttctccaatatcaatatttagtgttctcttgaatccagtttagtaaaaatgaaatagaagggcagacatttccttgtagtttcttgtaagtgtcatgtctgaaagcctgtccacataacccggaagtaaaaacctaataggtattgataattggagccgaggcagaactttgtatgccacattttctctatttattttagcttcattttgtctatactggttgttgtttgttttttatctttttcttttctaggaggaaaacaatgtggttcataaccagaaagtagaaattctgagaaaaatgttacagaaagaacaggaacggctacaggtattaaatgagaagtagggctgtttacaggccaataaaaatgtgagtgggcatggttgagttggtgtttatcagtcacaatcaagcagcattgtaaccaatgccattagttatattattgattaagaatggactatttctgtatcttttttacataagtaattaattctgaaaatatttttataacttttcagttattgcaggaagattacaaccgaacacctgcccaaagattgctaaaagagatccaagaggccaagaaacacattcctcagctgcaagagcagttatccaaagccacaggctctgctcaggtagcatcactattacaagtgctacccaactttttgcaggagaattttcttctgggaatgtgtcagagaatgttgcagttgccttttttaaagttatttttctagcgtaggacaacaggatgtcctgttaaggatgttacagaagtaatgattaacaaaaataaatgtgggcgtctgattgtttgcttgctcatgagatcacatttctttgttccataataatttaaaaaagaattgagtgcttttgctttgatgtgacaaactactaaaatgtatttagatatatatatatatttatattttttgtggttcattctgccatcttaaaacagaatggcagttgatatgtttttaaataggaatttaagaatttacaacaacaggcattgagctaaatatatggacaagcattttcttatttaatctgcataacatctctgaggttacttatggttgttttcctccagtttacatatatacttagagagagttagagagattaaatgacttgtctgaggtcatatagctgcaaagtaatagaactggaattcaaacccagtctgaggatttaaaagcacattcatactcttaatgactatatttttattgtaatttaaaaatagatttcagtagaatttgctgtatagttataagctatagagataatggtctcataagaaaaaaaaagctcagcatttatatgttaaccagacttacattctgtaatattcagatttgggatatgtaaagcaccttgtacttcatcttaaagcaaagtagataaattgcctatacatttaaaataggtaaaagctgtttttttgtcactgttcccgagttaaatctgaagggaaggctgcatattcgcaaaagaattctttgagatcatctagcctaatctgcttactttctgatttaaaaaaattatgttataattgagaaacctagggtctaaactggttaaatcacctatacaaggccatacagtatgtaaggtcccctgacatcctggtttagtgtacttttcattccattgtttttttcattaccttcagtcccagtagcgatgtcacattttgagtgttacacctcagtaatgttgacagttttatgttattactaggcaaatataatattcttaccctgtttggacagcaatctaaatgcttataacctggccaggcgcagtggctcacacctgtaatcccagcactttgggaggccgaggcgggcagatcatctgaggtcgggagtttgagaccatcctggccaacatggtgaaactccgactctactaaaaataaaaaaattagacaagcttggtggtgcatgcctgtaatcccagctactcgggaggctgaggcaggagaatggcttgaaccatggaggcggaggttacagtgagccgagatcctgccactacactccagcctgggtgacagagcaagactccatctcaaattaaataaataaataaatgcttataacctgatctaaatgcttataataatttatgttatagtattatgtcctagaattggccattgattgacactctgaagcattggaaggtagttaacaagaaactatagggtaataacctttattaatgggcagacaatataaattatataaatataaattacataaattaacaaaccattttatctttttgctatatttagaagtttgaacttacattctttttaccaaaatatcacttgccctgtctttaaggtcatgacattttagaataccggaattagtagttatttatggattttactcgtagaattttaaacatacttgagcatatcagaatgtccaacttttagtagtctccatgtagattgtagtaccactatttctttatgcagcaagtaatgaaagttttcttttatgtgtttgtgtgcgcgtgtttttctttcatctgttttaggatggagctgtagttacaccctccagacctttaggggacaccctaacagtcagtgaggcagaaacagatcctggagatgtactgggcaggactgactgtagcagtggagatgcttctcggcccagtagtgacaatgcagatgtaagctttcagttttctaaatcttttttcttctgtattcttctttacagcccctttctagatttgattttaagtgatgtgaattagaggtgtcttagcactttttaccatccccatttttaatgtaccaatttgataaacagaaatctggttactgttatatataagcttttaattccagagttcactttttcccttgaacacccattgccaactgtttcttttacagggatggaatttcccagcaggcatcttgttcgtgggtagagaagttactaatgccagtgcatttttactgaaccgagagaccaactgttgatatctttaagagcatgttaatattccatttgtggtcagagtgactcagtcttgaatcatggggcactttgccattaccaagaggaaaaacctcagtcctgttagataggcttcagttaatagcccaggtttagtgacagcactttcttgattaacccagaaactgccagatgaacatgactatctgttaagatgataataaaacattttaagctgaatatgatgtaacaccatagacatatgaatacctaaaagctaagttcagtattacttacccagcaatactttgtaaattgtatgcagtggtaggaataatgacttaaatgtagatcaccctctttaaaagtgatgagggaagaagtctgaacgaatgttttgtaattgtgggtcatgaaatcaattttgtgggttgtatttcttttttaaaaaaagaataggaaatacagtgctttgcatatagaagaggtgtcacttcttgggacttttgttacatatacacacatctactatttaacaatgtgaagtttctctcttattgaaggttgttgttgggggattgttttgttttgttgttttttaaaaaggaagccgtggtctaagccatcattcaggctatctcttgaggcttaggcccaatgacccagttcctcatgcaaaaaacaaactgaggatttgtgggttttttgttttgttttgttttgttttttaaggtagtgataggagtcttgtgattgggttagctaaaggttttaatggaaaatttcaatttgggctcaaggaaaaaatggtagtcactaatatttgttgggtatatgtcccatacacggtgataaggttttatgttccttagttaattctcaaaacagccttatgaagtagtactgttgttactgtaactttacaaaagaaaaaattgaggccaaagggagttaactaactttccaaacttattcaggcaataggtgatctacttccacctagctccaaaataccagtaatcgaaatataaacaaaagcactgaggtttgaaaatgcgtaacattttgagagagcagtgagaattttagggcaacctggcatattagggttatagatggaatggctagagattatcttagaagccaaatcatgaatccaggttataaagggcttcaacttgttctagcagtacataccgcttttgggaatgcttttcgtactcttctttttgttttagtaatgcgtctcctcgctgttttcatggcttgtccctaccatgagatgggaagttccttgagagcagagggactgtcttgtctgactttatgtttccaaagtgtagcaaattgtaggcattcagagcaaatgatacgaatgagaaatttgaattttatcttgtatttagaggaatgttacaataaaacatgtgacttagaaatataaccttataaaagagtgaattgttggctgggcgccgtggatcacgcctgtaatcccagcactttgggaggccaaggcaggccagtcacaaggtcaggagttcaaaaccagcctggccaacatagtgaaaccccgtctctactaaaaatacaaaaaaaaattaactgggtgtggtggcacacgcctgtaatctcagctactgcagagtctgaggcaggagaactgcttgaaccagggaggcggaggttgcagtgagccaagatcgcgccattgcactccagcatgggtgacagagcaagactccatctcaggggtgggtaaaaaaaaaagagtgaattgtttagtatagaaataggcattccaatcaattaagactgtttgacatgtaattgatacttagtatttgaatacatgaaatcaatgaataaagtgggctttatcttgcatgcagaagagagacaccatcagaaacatatctgtggaaaatgatttggtgtaaagagggagatctgtaagaaaagaagactgcttggcttaataggaactttaacaaatgtgtgctgaatggataatagttagcatttattcagtacctactttgtgccagaggttgtacccaatgctttacagatactcttttttaacactcataataatcttaaaaaagcagtatcaccatttcatagatgaggaaactgaggccaaataaataaatgaatattgtggaaatccgagtgagaaatgataaagtccaagctaggctatcttctgaacacagaacacacaggtttaatttctacaagtgtctgaggctaaagatgtgttgcttttagcttatggatttccatgtttgtttcaattttaagtatggaggacccggtctgcttttgttgttgttttaacagtactttgagtcgcggttttacattttatcttttgaatcagtgcttttaacttttttcattgtcttctcatttttataaaataatttcctggtggtgtttgtgaaagttccctgcttttgcttaccttggagaaggctttaaagaatgccctgatacccagttctcacaagagaagcaacttggtaacaaatcatcatctgaaattcagagcatctatcattttgattttcagtttgtgagtgatatttttgaaaaattatttattttggaaaattgttaaacatattcaaaagtaaagactaacataatcctcctcatgtccctgagaacctagtctcagcagttttgtttgtaccccctattcctcacatcctccaaacaccagattaaagtaaatccaaggcattcgtttattaatatgtctctctctaagagataagaagtttttaaaatatagctataatattcttattaaatcctaagaattaatattttctcaatacacaattttattaccttgttttataatgatctttttacagtttatttgattcaggatccagtcaaggctttcatattgccattggttaataagtcattttaagtctttataatttataatagtttccttcttttttttccttggccatttgttgttgtggttgttgttaaagaaattgagtcagatgttcagtaaaacaatccattttctaattatattttcatggtgtcgtatgacatgttcctttatctaaattttcttaaaactcctagttaaatctacaagtcttgatcacattaggtttgatagttgttatttggaataattcatagatgatactatgtacatctcattatatcacatgaggatgtgaatggctgtcttactgtggttgtaagcttaaggtgtttaggtgatatcaacatgatttccttcattataacgtcccctgtcaagcttttttttttttttttttttgagatggagtctcgctctgttgcccaggctggagtgcagtgacgcaatctcagctcactgcaacctccgcctcccgggttcgtgccattctcctgcctcagccttccgagtagctgggactacaggtgtctgctaccatgcccggctaattttttttgtatttttaatagagacagggtttcaccgtgttagccaggatggtctcgatctcctgacctcgtgatccacccgcctcagcctcccaaagtgctgggattacaggtgtgatccaccactcccggcccccaagcttttgtgaaatgttttcacatgccatttatgatcaaaatgcctagatccattgtttaattcagagtttcaaaaggatattattataattttgtcagtatttctgtatttattacatggagttatgttacaaaaaatgatttcccttactagctaataggttaccctaaaatacagcttatacagaaaatgtagggtaaatacttctcttgattcttttcagaagagttttttcaggagagatgatactcttacaaactccaaaggtgacaagtgggaagggtatatgtgtgtaatattttgaactcatagatttcagtatgagttactcttttcttttgttggtgggagccccctcaaattttctcctgtgttcttttgacatgcccctccaatatctttgatagctttcttgctttttgtgacagaattattctaatcttttatatatcttgtccaagacctgaaagtcattcatttctccaaggtggggcatacatttgaaagtgctgttttctcttggtaacagaaatatctgtgataccaccaagatatcttgctatatgcataggtaaaatgtatcttccctattggcactcgttaggtctctggttcctcattttcattgctctaaagaatgtctcccgttgctttggggtgttcctcatctccacaaagtgagtttctgtgtctcatatagttcatattttatacagaagttctcagtatttgtggacagcatctgtggattcagccaaccatttatcaaaatattcagggatagaaatgcatctgtactgaatatgcacagacttttttcctagtcattatcccctagacaatacagtataacaactatttatacagcatttatgctgtattaggtattataagtaatctagagatgatttaaaatatatagaagatttgcgtatgcaaatactataccattttatatcagggacttgagcatccattcccccacaaacactgaagaacaactgtattaggtattatacaataccatataaatgtattaaaatccacctttcacatgaagcgagtaacagaatagtagaagcttaattgtactcataagtagggcaaaatgcttttagcttggatagaaaggatagtttgagaaggtaaggattaaggaagataagagagtttgattttgacataatgagtttgaggtatgcagtatatctaattatttggtagaaaagtaacctccaggcctggagattaggtaaaattgttttgttgattctgtattgtttatcaatataaaattgaaaaggtgagagaataagtgacttgccaaagtaaggaaaaagtagcagaaccaagcattttacgaaagatatttagtagttgtaaatacaaatatgaaattcagaacaatttttttttcacacttttttccctcatctccttttggtgtgcctattgaaatgaactgaagatcttgtttttttcattagagtcccaagagtggcccaaaagagagaatttatctagaggaaaacccagagaaaagtgaaacaattcaggacactgtgagtatgaaatccatgcaatgatagtgctgtctttggctttccttatacttaaagtatggtatagacacatctgatgtttacatattttattttttattttttggaaaaaaaattaaaatttattaaagaaacttaataaagatttgaataagtcaagagatattccatggtttgtaagtattcttaggttccttcatatttgtcgtggtggtaacataaaatgtactagtttaaccatttttaagtgtatagtggcattaagtatattcacattgttgtgcgaccatcactgccaaccatcttctccaactgcaatttggtacccggtaaacactaagtctacatttcccccttccccctagcccctggcagccaccattctactttctgtctctatgaatttgactactttagatactcatgtaaaaagaatgatacaatgtttatccgttcatgactggcttctctcacttagcatatgtcttcagctttcatccgtgttgtagcatgtgtcagaatttccgtcctttttgagaccaaataatattccatgacatgtatatacaccacattttgtttatctgtccgtttgtcagtgggtacttagattgcttccactttttgctattgtgaatatgctgccttgccttcagtttttgtgggtgttcatcaagaagaagaattgtttgatcttacgtattcttaattgcatgcttttaagcactctgattttatcttctaattacatttatttacagttttgtagtaaaagatacaacagcattttgtcatctttttattgttagcaacataaggactattgaaaaatcagagacatcaaatcagttataaaatcaaaattgtctgactactgctcgaaactaatttatgttgtttcacctaatttcttttttttaattttttaatttttcctttttttaaagagggagtttcgccatgttggccaggctgttctcaaactcctgacctcaggtgatccacccgcctcagcctcccaaagtgctgggattataggcatgagccacagtgcccggccagtttcacctgatttttttttggaatattaaagccttgaggttaaagaaaataataagagttgttaaaaggcagaattgtgtttaggagactcaatatgtagtgttgcaacactaggaggaaaaactacaggtacatattattcactcagtttaaaacttgcggatctgtttatacaacttcagctatagccactataactgctgtgcaaatgactctcaaatcataggcctacccttctttgctgaactccatccagatcttgcaatgttaaactgctgttagatttaagccaaactcatttttttcctatttcttccaaaatttttattccccaatcctatatggtctttaattttagtacttatggtcttcagacatcctgtatgtatgtatgtatttatgtatgcatgtatttatgtatgtatatatgtatgaatgagacagagtcttactctgttgcccaagctgcagtacagaggttaactgtaacctcaaactcctgggctcaaactgtgtacccactttggcctcccaagtagctaagactatagacacacgccaccacgcctggctaatttattttggtttttttagagatgggtcttgttgtttttcccaggctggtttcaaactcctggcctcaagtgatcctccctccttgacctcccaaagtgctgcgattacaggcctgagctaccgtgcccagcacccatgtttattattttatatattaatgcctctgtactgccgtttttgtgctgaatctaactttgtgagttgacaaatggaggagctattgcatgggaaactatctgacaatctacaatttattcttagaattttgttatctttgtttctatagcagtgtttgtgagattacttgatgattttagagcattgtatcagtgatttttcaatcaagagtgattatgcctccgtggacatttgacaaatgtctggaaacgctgcagctggcatctggtgggtgcatagaggtcaggggtgctgctaagtgtcttagaatgcacgggctagaccctacagccaagaactctctggcgcaaaatgtcaacagtgccgcagttgagaaaccctgcattatacatttatgaaaattaattaaaaatgaaaacatagagttcgatgatagccttcaattatgtatcattaatggaaatcttgggttagtacttctcaggtatattagcctctctgctaactttgtcttaccatttctgctcttatttttcctttctcctattgtcttcattcactttttctttaattttttaattgtaaccatttatgtaagccaactttatttttttctgtaagaagttttaagtatgtatgaattaataaaagaatgtacagaagtgtacagaaagtgttaaagtcagataaccaagtgtatagtgagcaaaggatatttactgtttccaaggggagtggttttttccccccaaaaaaaactcgttgttgtggtctttttctctgccagagtggtacatggccttgaaaatttgtgaacccctactttgaaaataaagtacttcaaaggaaataaacaaaaagaaatctcaccatttaagtgaaccatgtctttttgatgggttggctttattctttttctaaatttgaccaccaggtaatttttctgtttcttttccctgaatgttgccaggacactcaatcacttgtcggaagtccctcaacccgtatagcacctcatattattggagcagaagatgatgattttggtactgaacatgaacaggtgatgacttttttctttctaaaaaatagattgttactttctgcaatatctgatttgttgcaaaaatgagcacgttctggagattaagataacatttgtaaggatttgaagctaaatcttagaaccaatagctccttgggttaattgcttattttagctttgaccaacagaaatgaccttgcttttaaagccagtgagagatcattaatatatgtttaagtacttcattttattggggttgagtgtgtttcttaaaatagtatttttaaaaaaaatttcaaatcccagttcattggtgctataaaggaatatgattagctagattcttgtccttgtatcctgtgatcttgctaaattcacttattatttcttggtgcttttaaaaataagtcttttggagttttctacatagataaatatgttgtctatagtttttatttccttattttcaagctgtttatcttttatttcttgttcttgcctttattgcactggctaggacttccactatgaggttgaatcagagtgacaagacatgcttgccttattcctgctattagggagaaaacactcagtctttcatcattaagtatgatgttagctataagtattttttagaggctctttataaggttaagggttattaggttaaggaatactcctggtttgctgagagtttttatcatcactggatgttgaattttgtggaatgagattattatgtggtttttctgattgtctattaatatggtaagttatgttgattgatattagaatattaaactagtctcgcattcctggaatgaacctcagttggtcatgatatgttatcccttttatatattgtcggtttcaatttgccatattttactgaggattttttacatctttgttgatgaaggatattggtgtgttgtttttctttttgtaatacctttgtctggtttgatagttgggggtaatgctggtctttagaatgatttgggaatatgaaaattgtgatgctagtttacattattattgttttctgtgttcagtatatttagggattatacaaatattctaggatttgtcttacttaaaatcatacaacttcatttcccaccatttctgcaattagcccagaagaaaaggataaacagctattttatgattgggcaaaaagccttccactgcatttctagaaatgttagactgttttttacatactgatttgtatacatccgagctacttgataatcgtctcctaaatttccgttctcccacagtggtctttcttctaacctatccccaagaggtggttaatgttcacagaaagagattccatagcttctgttgctaataaattttagtgaagttttttaaatcttgaattttttatagggagatcaaagtgaaatttggatagctatgttcaattgagcctactttgcatttagtatttgtatgttggagttactgatgcataatcatttcttcctctagatcaatggacagtgcagctgtttccagagcattgaattactaaaatctcgcccggctcatttggctgttttcttacaccatgtagtttcacaatttgaccctgcgactttggtaatatattttacaatctagcagattcagagttcttctgttgattcatgtgccatagaacttttcctagctatacaacgagtgggcagacttctttcagttttccgtataaagacagatacaaaagataattaaaacattatttttaaagacttggttatatagtaataactacattgtttatggtgacctacctgttccagacattcctactcaatggtgacctagcaaattacatttttcatggttcctcattttgtctttttcattcctttctccactacagctctgttatctctattcagacctgtataaacataccaattccaaagaaactcgtcgcatcttccttgagtttcatcagttctttctagatcgatcagcagtaagttgccaagttaatgttgtaatctttgccttagtacatggaattattgtcctcctgcttcctatcttccctcccatgtttttggattttactgtgctttctcacacctgtattatatttcaattattgattactctagacttttttttttttatcatttctaaagtagtttaggcatatgaattctcacagtaggttttaggggattatatatatatatatacacacacacacacacacacacacacacatatatatacacacacacacacacacatatttgtgttttttgcatgtgcataattagagtgaggaaatgaaaaagggaatacatatatattaagacccaaggaataatacttgaataactgaactctgggtggcctctttgaagtttggaggcataattttaactaaaaagtggcagaaaagatttcacttacactgaaataaatgatgataacgttatattttgtcattaaaagtgttaataaggtttttaaagtagtaagttttattattagtcttgttatgggtaaatagcacctagcccttaatgcatactggataatcatgccgcaggtccctagtcctttcacatttgcagttcccttagacgactgcctcatgctttttccctcctaaaacctccatcacttcctttcctagtcctttctcagctgataaccttgaccttattgtttctctgagaaatttaaagtatatagaagagaacttctaccagatgtatcatctgccctcattataccataccatgtactctactctttctcctgatgctatggagtgactgtcttttttttttttttttttgagacagagtcttgctctgttgcccaggctggagcacagtggcacgattgcacctcactggaagctctgcctcctgggctcaagtgatcctcctgcctcagcctcccaagtagctgggactacaggtgtacaccatcatgcctggctaatttttgtattttgtagagccggggtttcgccatgttgcccaggctggtcttgaactcctaggctcaagcaatctgcctgcttcatcctctcaaagtgctgcgattacaggcatgagccaccgcacctggccttgattgtccatcttttatccaaggccagctctgctccagtttacagtgtatttccttatacctactcaaagatcttactctaacaattatcctcccttctcctgcatcatcggttttatattttctacagataatcattcacattagtctgcaaatgttgttattttccctttctaaaaacaaacacacattttggctctacttctccctccaactcctgccccgttttctttgtatgcctttacaaaattgtctgtacactttcacattcaattacctactcagtgactttcctaaccaacctacttaaaatctcaaccctttcactttgtcactttttctattatttttgtccatagaacttttatttagttagttagtttgtttacacagtcagtcttctgtgcctgcagcttccacgaattcaactaaccatggttgaaaatattcaaggaaaaaaacaaaagccaataccacaataaaaaatgaaacaattttttaaaaatatagtataacaactatttgcatagcgtttacattgtattaggtattataattaatctagagatttaaagtatacagcaagatgtgcataggttatatgcaaatacagtgccattttgtacaacggacttgagagttcgctgattttagtatccatgggggttcctagaaccggtaccccatgtggatatcaagggatgactatattcctactctcctaccctgaatataagttttattaggccagatatttttattctgtttgttcactgctgtgtccctaacactgaacagttcctgggacatagcggggtcacttaagtatgtgttaagtgaattagtgttctgatcctactcccattgtttaaaatattgtgttatttttattaaaataatttactttcctaaaaaaatgacaatatattgaagcatgtttgaattttgcatttcttaagagggcaccaagctaagtcaaaactttacattttgctacacatgatctatatatcaatattaaagtataagaagaatccttacactttgattaatttgctaattatacttttatgctacagctcacatttatttcatatatacaccatcatacagaaatgagcttttattacttttttgcacttgagctagaaatgcttttaagaaagttgatttgagctactgcctgtcaaagagaaagttttaaaatccattttacttttcttcaaatgaatataaagagatcttacaatttttagcggtgacttattttcaaatttaaaacttcagatcttataggatgtgtttaaattctgaaattgtatgacttaaataggtatacaatacaaaataagcaggaagaggttaagatattttctcttaatgcaaaataataaagtattcccctccattagtttgggggtgggggaaaacaacagactggtaattattatgcaaatattatggggaaaatcctagctaggaataagtaaattctaagatagtcaccttatttggttcagtagcaagaactgtagatggttgctggagatttaaaactccaaaaactcaacattgacattcaatattttctcactgggagtgtgacattgtgagggctcttaaactttacataggaaaacgattaggaatattattggtcttcagaatgagcatctcaaatataggaaagaaaaatcatggctatatgtgagtacatttttcatatgataatatacacataatttaggttttacctatattgatctaaatgacatataactgattatattgaccaatgattctaggaagccaaagccaaagccagtatattcattaagtgtgtcacagaagcattcagtcatctagctaaacgactgtagacttttcctttatagcatgatcctcgggaaaagggctcattttcaagtttaaacgatagaatgttctggagttgtgaaatgtgaatgaataaatgagcttgtacttgattgtgcttgtagagtgggtatccaagttgtatccccttactttacagaagtacttatgtacatcttcaaatatctttagcgttgttacaccttttgtttgcatttcattttagcacctgaaagtttctgttcctgatgaaatgtctgcagatctaggtaagcttggagcactaacatcctggagaattacatcttaatagatatgtagctcagctcatctgttcaggttttatctgtcacatggtgactagtcgatcacctgaatcacaacagaaagacagtctataatacatttaaagagtaaatgaggccgggcgtagtggctcacgcctgtaatcccagcactttggaaggccaaggtgggtggattacctgaggtcaagagttcgagaccagccttgccaacatggtggaaccctgtttctactgaaaatacaaaaatgagctggcatgatggtgcatgcctgtaatcccagctacttaggaggctgaggcaggagaattgcttgaacacaggaggcggaggttgcagtgagctgagattatgccattaacactccagcctgggtgataagagcaaaactctgtctcaaaaaaaataataatatggctgggcgcagtggctcacgcctgtagtactcccagcactttgggaggccgaggcgggtggatcacgaggtcaggagatcgaccatcctggctaacacagtgaaaccttgtctctactaaaaaacaaaaaagtagctgggcgtggtggcgggcgcctgttgtctcagctactcaggaggctgaggcaggagaatggcatgaaccccggaggtggagcttgcagtgagctgagatcgcgccactgcactccagcctgggcaacagagcaagactccatctcaaataataataataataataataataataataataataatagagtaaatgaaatcagaattctgggatgaaatatacgaactgccctgaagaacttccctctggcatattctaagttaatttgtacgaagtagcattgctatgttgccaattgtatgttgcccagaacatacctttagataacataattcctttcatttatgaagaaaagagaagacctgagctcattcctgaggatctgcatcgccactatatccaaactatgcaagaaagagtccatccagaagttcaaaggcacttagaagattttcggtaagcttagtggtagatagaatttcatatgattattctaaattaatttttttagttaagaaaaagttgctcattaaatacttagcttagcactagataaaccatatggtcttattgttattaaaacataatgaacatctggagccaaagggttagagtggaactgagagtccagactctccattccaggcacttgcaggatctgagctcagtgctgtgtctatgctaagtgtgttcctttaagatattgtatgtgttcttggagtcattgcttctagaattttttcctctggtatcctagatgacatggacccataagtggaaaagtgacatttttcctgttcctagaaaccatagctgtgaagactgtgatgaagcgtccccagaatgaggtagtttttctttaggctacctcaggaaacttctctattcccttcaggcagaaacgtagtatgggactgaccttggctgaaagcgagctgactaaacttgatgcagagcgagacaaggaccgattgactttggagaaggagcggacatgtgcagaacagattgttgccaaaattgaagaagtattgtaagtaatagaagtatatgtggaaatgccctctctgctgagatactagttatgcttgaagtgtcctttgggtaggtttagaaaaactgtcagattgtgtatgtggagccgtttattttgtcatagtacttgagaaactggattttttttttcttttttctgatacttttagataaatttcttgtgttcctttttctgggtggtggtaaatgggtaactctaaaacttctaatcagtgatcaaaaacaggttgattactttcattattttcaatttataggccttggaaatatttcttgccatgaagcatatacagttggtgacatgagggtgaaacagataaggttctttaggggatcagggttcttttggtattttattctagggtgtggcccaaagcatttggctctgttctgttatttcaggtatctgagttaataacaatttttaaggccaggcatggtggcgcactcctgtaatcccagcactttgggaggccgagcgggcggattacgtaaggccaagagttcgagaccaagctggccaacatggtgaaaccccatctctactaaaaaccccaaaattagccaggcatggtggcactcctgtaatcccagctactcagaaggctgaggcacgagaatcacttgcgcccaggaggcggaggttgcagtgagccaggatcatgccattgcactccagcctgggtggcagagtgagactctgtctcaaaaaaattaattaaacttccatatttcatttttaaatttttttttcttttttttaaggatgactgctcaggctgtagaggaagataagaggtaacataactgttttttttcccctagaattttaagaaaaaaagaactatgtttttttcctttcagtcctaaattacaatttatttcttttaacttacaaatacagtttgtggtctctctctggtggcttgtatgttatttgactaatattctactgttgtcctgagtagaattctcttctctgtgcaatgactagttagttctttagtgtttgtttgatttatttcaataattccaaccttggggttttggaaatcatttgatgtctttattctaccaaccctcccttctcagaagtcttaatttacttcgtcctttctcctccagctccaccatgcagtatgttattctcatgtatatgaagcatttgggagtaaaagtgaaagagcctcgaaatttggagcacaaacggggtcggattggatttcttcccaaaatcaaggtaagaatgaaataatgtaatagcatgttcaggccttagggcttctttacatttggttgcagtgtcttccatcatcttagtatttacttaatcagcaaattaatgctagtcatacaaacatttataagatactgtctctgttctcaagaaactcaaaatacagtgagaaatccagacatataaactattattagacaatgtgaaaagtgaaattagcagtttacaaagagtgctatttctgattctgttcatgccttatactttccttttactttgcctaaactaaataccccctgtgttgctacataatcgtcatgaacatctttagtggcagtagagtattctgtcagtttgtaattatttgtgtttttgtttagtgtttactagattgtaaagctgtatgagtacaaggaccttctttattattgtattttcaactgttagcaaaatgcttagtaaatatttgttgaatggatgaatgaattgtttagaataagttcctggtaaatgtgctataaaactaccctttgattttccaaagctgtcagtgataaagagtttgaagaaaacatcttgagtttgaggtgtacacggtactgtgtgcgaacttttaattagtgctctgtgtgcatacacacgtgtacgggttttcatttacacttaacaatttctttgaactaaccattagcattacactatgaaaatcgcaaaagaaatttactctgttacgtatctcttattttttgtacttcaactctagcaaagtatgaagaaagataaagaaggggaagaaaaagggaagcgaagaggattccccagcatcctgggacccccacggagaccaagccgtcatgacaacagtgcaagtatgttgaagtttgaagtgctgcattttcagtactccaggccctcttcacatcagaggcttcttcagctagaatgaatttctggagaaaggagttgttaggatgattttactgaattcccaatatgccttgtttccattcagcgttatttctgaactaagtaccccctatgttgctacataattgtcataaacatctttcgtgggctgggcgtggtgattcacgcctgtaatcccagcagtttgggaggctgaggcaggcggatcacaagttcaggagatcgagaccatcctggctaacacaatgaagcctgtctctactaaaaataccaacaattagccaggcgtggtggcatgcgcctgtagtcccagctactcgggaggctgaggtaggagaattgcttgaacctgggaggcagaggttgtagtgagccgagattgcaccactgcactcaagcctgggtgacactggagcgagactctgcctcaataaaacaaaaagaaaagaaaaaaaaaaaacgaaaacacacatctttagtggcagtattctgtcaaatgtccgtaacatagtttacttacctcttctgattctgtttccattcaacttgtgtttgttaaattaaaaaaaaaaagtgtgtatagatctctccaccacactgaacgtctctttatacatatttacttagtctccatatttctaaaatttctccacctctccattgtactttattttctgatttccctttcaccccaggcccaataaagagagataagctcacttgagatggctgcaggagaaatagggatggtggtaccatggggaggggtcatgtgatggttcttatctcaggcagtagcacatttgaaaatactgaagccaggtgcggtgactcttgattgtaattccagcactttgcaaggccaaggcgggaggatcacttgagcctgggagttcgagaccagcctgagctacatagtgagaccctgcctctacaacaagaacagccaaaataagctgtgtatcatggtgcatgtgtgtagtctgagctacctgggaggctgaggtagtattgctttagtctggggagtccaggctgctgtgagccatcatctcgccactaaactccagcctgggtgacagagtgaaacactgtctcaaaaaaaaaaaaaaaaaaaaaaagatattggcatggtagagtggtgggagtaggattgtgatagtgagtgtcccccacaatgacgagttctccctcaaatgccatgagtgcctcttgttgagaaacattgagaaggtgtgaaatttttagaggaagttaaagagatggaggatttcacagatgctaaccgtgagttccaaggtatacaaaagaagaatttgaggaattaagagattagggtataaaaagttgtgtgagggtgtaggatgctttggatattgaacacctgagtgggagtctttggcttcttgtggtgactttgtgaacaaggataattagcaggatggggattggtctggatggtctttgaggtacattatgatgatgaaggtgtgagtgttgggggagaactggggtgggagcttactaagaactcacaaaaataaagacttcatcttcattcttacaaatgaacacagctccatgtctctcagcattcctcctccctctgtccaccattcctctccttcttttctcatgacccttcttctttccctacatcctcctcttcctcgctttcgtcgtcctgcctcacccctcctccatctcctcatctttctgctctaccttcctctccctttctctcttttcttcttccttccttcatctgtctgtctgtatgtttctctgcataacaatccactatatatattttttagggtctaccatgtttcacacattttaccagattcttttacattgtccttttttgcttttagctaatttgcaatgcagattattttatttattttatttatttatttttgagacggagtcttgctctgtcacccaggctggagtgcagtggcgcaatttcggctcactgcaacctccgcctcccgggttggagcgattctcctgcctcagccttccgagtagctgggattacaggcatgtgccaccacgcccagctaatttttgtatttttaatagagacggggtttcaccatattagccaggatggtctcgatctcctgacctcatgattcgcccaccttggcctcccaaagtgttgggattataggcttgagccaccgcacccagccgcaatacagattattaaccatcattttctgatcagttggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggtgagctattactgtagttcagcttaactaagcatcaagattttaaaacaaacacactaactgaaaaatagagtggcaagttaatcaagactaaatcccagtttaatttaattttgacattttaatatgctacaaccaataagaaatctatgccgaatgataacttaagttctcatttgtccaaaaaaatatttattaagctctctgtcaggcattagctttgtcccggatgttaacatgcaataattatacacagatgcttgcctcatgcagctttctctcttgagagcgatagtcacaaatgtaaaaaatgcaaattgtgccaagtccaatcaagggaaggtaaagggagtattgagggaactggtcagtagttagaggcagatgtgggtatctaaagaagactttttaaaaatctgagattaactagaggttttatttttcaatgttaataggaagccagctgaaagaaagggtagaatatgtgggagacagtatataagtagtagaacagagttgtgaggagagaggagatgagatgtagagtgtatgtaaagggtaagactatttactgagagtgagagttcagtgagaagagcaagggaatttgaagagtaaagaaagatatgaagcaatcgtaggtaattgggcaaggagcttattaccatgtcttcatccttgtttgggaggcggttcaatttctggtggtgacatgatcaagaatgaggctctgggagtggtccctgaggtgccatagaggaggctactagggatgaagacggcaaggaaccaagaagccaggagtttgaatagcttaatattcatggctagtgacgtcaccaagtgtgatttttatcatggagaggaaaactgtgagccaccagccaaaggtttagcattgctagatgattgatatgaggaggaagagaatgtgataatatccagagcatgagagcctcagtggagcaagagattatacaggaagacaaggtcgggtgcagtggctcatgcctgtaatcccagcactttgggaggctgaggcgggtggatcacctgagatcaggagttggagagcagcctggccaacatggtgaaacccggtctctactaaaaatacaaaaattggccaggcatggtgacatgcacccgtaatcccaggtcctcgggaggctgaggcaggagaattgcttgaatccaggaggtgggtggaggttgcagtgagccaagatcgtgccaatgcactccagcctgggcaacagagtgagactccatctcaaaaaacaaaaacaaaaacaaaaaaaaacgacaagataatggtccaaaaatcatattgaggaacaagaaggccattcatctcatctccaccctgacatacaccatataagacagaaatattagtttctgtctcagagggctgtagcagaagaggtaagctgctgggaataggcaggtttctacataaggccaagaagtacaagtgacatttggagaaaattctggggattttgtcaaatatggaactctgaagatgttagattgggtatatgcactgatatttcatggctcctgtgacttattaaaataaaaacatggtaggtggcggatgaacagaaaccataaagagaaagaaagtagaggaagggaatgtgttatcaggaaataagagattttaacaaatacttgggagattgaaagcagacaagagtgtaaagaagccaggcatggtggcttactcctgtaatcccagaactttgggaggctgaggcaggaggattgcttgagcctagaaattcaggaccagccagggcaacatgaaaagactgtctctacaaaaaatgaagaagtcagccagtcatatggcatgtgcctgtagtcctagctaatcaagaggctgaggtgggatgatcacttgatcctaggaagacaaggctgcagtgagccatgttcttgccaccgttaatgcagcctggatgacagaatgagaccctatctcaagaaaaacaacaacagagaaccacaagataaaaccataaaggaagccagagcccacaatttgtttaaacagtccaagatagaacccagtctgctcattggaaccctggagagactttgggctcagagttagcatatgttatgcagtgcaggaataagaaaaagagcaaaaatgatgaactaattgcaggtctataatcaaaatagttatatcagcagcttctaatccctgaattacagagtatgagcagtctctgtcacttgtagactagaagaaaaaaacagtgctcttttttaaaataattcagtgaattgtgtagggagagttaagtccctccgcagtattgatcgcttggagttctgacatttgggagtccaaagcctgacactaggcatgccggcaacccactgtgctcagagagctctcaactgaaacagacctattactatatagcagcaaaagaaagccaagtcagctactcactttcatcattaaacacgaacatcattactcacccttgtcagagtcaagacgtaagataatatataatgccaaacatatcagacaatgacataaagagagaatacagttaaacagaagaattttccctacaagagaaagataatctgataatagacaagaacttaagaaaatacttctaaattaggtagtatacttggggacattaaagaagttattatctctataaagcaagaatagggagcattcagagacaaaatatttttaatacaactattaaacacagtgacatctgttgtattatcaatttctgtgtgataaattaccccaaaacataatggcttaacacaaaaaaaatttatctcgactttttggtggatgaaggactccagagcagcttagctgcgtgggtctcggttggagtctgtcataaagttgcagtcaagatattagccagtcatcagaaagcttaactggggctggggaacccatttctgtgcccactcaggtggctgttggcaggaggccttagctcctcactcatggccttggctccttgccacatggacttttccatagagatacttgagtgttccatgaaatggtagctggcttttcccgagtatcccaaaaaagagagcgaaaaggaagccccaatgtcttttctgacttagtctctataggtgcactctgtcacttctgcaagttagaaacaagtcactaaatctagcccatactcagggagggaggaattaggctccacccctgaggggagaaatatcaaaaaatgtgtgggtatattttcagaccaccacagcgatcagagtttaaaggaaaaaaaagaagtccctaaaattaaagtcaaggaaatattttagagtgtacatcagaaatatgaaaggatagaaatttgagagaaaagaattatatagggaaccactacagagagccaacatctgtctctttcacaaaaagtcagctgaggacatggagaagagatggttaaacaacaggagaaagtttcccagagttgaaaaagaatacccatcttcaggtggaaagggctcactgagaaccatctatagtgaatgctttttaaaaaatccattcctaacatgtcctttgaaactgtagtgcaccagggataagctttcagaggaaaaaaaatggggattacactgcatcacattcctcatcataacactggatgctgaaatacaaaagagccatgccttcaactttctgaaggaaaatggttttgaacttagaatcctgtatccatccaagctattcatcaaatatgaagaatgaataaagacattttcagatacacaaggtccacagtttaactggaatgtacctttccctttgaaatcatttgaggatacacattctagcaacatgagaggaaaaattaagaaagaaaatgtcctgggatccaggaaacactggaaacacccaggaaagtggcaaagggcaattctaaaatgatggttgtgtaacaggccaggagagccactgctccagattggaacacaagaacatcacagataagaaaatggggattttaggcagtggatagtatgaagcagcagaggaaatagtttgagacttgatagaattatataactttgacagcaataaaagaaaagcatttagaaatgttaagaaaaacagaattgttcaggaaaataagtcatgatttaaacatgaagcaaaataaaaagtggcatgatctttagcaattgatggtgtgtaagaaagactttaataaatgttctatttgaagtggcccatggattgcatcattggaccggtaggaaaaaatatataatcctaactagtatatttcttaatctggcaggaatgatgtatatatgtatgtagtagacgacagtatatatatgtcataagcattctttcttggttttcagacttttagaataaccctaccaggcaagcatggagtagttcattatggctgcaggttagaatataaatgtaaaaaattcttttaatgatgcaagtaaaaatgtagttgaaagaaatggaaggtagaaggaaggaaatacaattagagggaggatgtggacactgaatacctaatctgacacagaagagagttgagatactaactttttgatagaacaaaaacatagacatgtcatttaaatttaggtagtaactaataacccagctagtaataatgataaaactattaaacattgggaagaaatggtagaaaagtgaaagtggaaagtgtaagtcaacaaaatcctcagaggggaaagaaatagatattaactaaagataataaatcatgaaaaagaggttatttgtagttggaccactgtaataactcacatttgaaaacatgaaaaaggattgatactgggagtagaaaaggataagatgggaaaatgttgttcctcatcatatactcttctgcactgtgtgagtccttgctatttcttacgttaatttttaagaaacagttttaaaaattatttttctgaccaggcatggtggctcacacctataatcctagcactttgggtggccaaggcgaaaggattgcttgagcccaggaattcaagactagcctgggcaaagtagcaaaaccctatctctacaaaaaaattaaaaatgagccaggtgtgtgtggtggcacgcaactgtaggccccgctacttggaaggctgagatggaaggatcatatgaggctgagatgggaggatcatgtgagcctgagatgccataattttgtatattaaatttttagttctagtgaacctgcagttgtttaaataagaatgtagctatggattaggctgaagctgttctgggaactaattttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatggtgagtgtaatcaatttgttgttgttgtttacaaatactgagttttgtcagagtgaattaagtctctcagccttggagtttgcttcaaagtttctcctagccttttgttttaaacaaagaggaaattaaactggacagataatccttgaactcaagaaaatgcaaatgtttctctgattcttattgataatttaaaaggaaaatgtgttaagccttaaagatatttaagattcatagcattatagatcttaaagttgaaaagtcattgcaacaactaagttatttttatgcatagattttaaatgaggaaggtaaagcccagggagattgaattcgttaagatcatacagctaataacgtgtaaggaaaaaaattcagttcctggtctttctgtatcgaagtgcagtgttctttatttaccctagcatgtatgtgataaatgtgtggcatgggtgctgtaccctttactatccttagcatgtgatatgaataaatatcttgtctctgacaatactgagacataatgaaattataagcctgaccccagaagtgagtgtttataggcaaattagataaccaaaagtactattatttcttaagagggctcaagttaaaggctatatgatgttggggcttacagttttcttaatgatgtagttgtgataggtgggtattattgtaaacagctggatgtgtttgggaatacactaaaaaaaatagttttgaatgatattttttatttgtcagtattcaactctcagagccagtatgtaggaaaatttcttggaatcagaatgacttcagagatatttcatcctttctaaatgataaataatttattatataattcatttgctacttcactccagctaaagactatgattgatcccatggaattgttctaagtaaggcaacatttcatatctctttcctgttcagaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatagtaagagaaattagctctgatctttgcccctaacatttccaatagagaaaagattgtgagtttaaaattttgtaaatgtacccatgttagtattcctgagattatgtgtgagaatgtaagataaataaaggaatgattggaactttgactagatccttttcctcacaatcaatctttcatgtacaatgtgtcaacatagggcttccagtctaaagtcattgcctaaggtgaaaaacatgaatagtcaaattcaccgttgaaaattttctatcaattatagtatatatatctctttaaatatatatatccaatataataatatacgtataaatgtgttttgtaaatagtagtgtatggtatataatcacatggttcggtaatttttaggaattgtttttatttttttgagatggagtctcgctctgttgcccaagctggagtgcagtggtgcagtcttggctcactgcaacctctgccccctgggttcaagggatcctcccacctcagccacctgagtaactgggattacaggcgtgcgccaccacacccagctaatttttgtatttttcgtagagatgggtttcaccatgttggccaggctggtctcaaattcctgacctcaagtgatccacccgcctgccttggcctccaaagtgctgggattataggcatgagccactgccccggcctcaggaattattttattgttttgttgcttggaacacttgaataagtatataaaaattctaccttgttgacattttattggttgaagtcatcttggacttttgtggacagtaatatgatgttcctctcatttataggtcactatttctctatgacccttaatttttttatctttctttttcatgtcatcactaactatcaacatctgctaactaaattgatgccttttattcctttgtggataatcttgggtttcacaggcatgcattgacaagttcaggcttgattacatccattgcctgcacacttaacacattttgagaggatcagtgaacagaattacttgtactgtttaaattcaagttctttttgagcatgattatagatggagtcttgaggttcaatgaatatttgatgcaaccaccgtgtatgtaatgtgctagtttccaaaaatgttttttgtttagcacctgtttttcagatagagcttataatatccagatgtgtaagcactatgtccagatttatatttaaggagataagaagcagctgtactactgtgaaaatcgtctttataaaaaaaaaaaattagctactctgtactaccagtaattctgtctacactgaatgtgttactaacgtttttctatctttttatctttagttggattgaatgaacaaatgaaggctgttcgaaagagaaatgagacctctgttatcgatcagattggggaagatttgctgacatgggtaaggaaattttctgtttctttttaatatttttatggacacttgatggttagattcaagttgagtaactaacctttccaaatatgcaaactcatccatgttgcaaagttaatgcaaagctgagaaaggtcaagcagtagattccatttcaagaaaccacctgttttgctcatctgtaagaagcagacccttatccattaaaagtcataccatgagattgcagtgattcagtcacaccttcaggctccactgtaatcctagtttttttgcagttacctcttccactgaagtcttgaacccctcgaagtcacctatgagggttggaatcaacttccaaactcctgttaatattgatattttgacctcctcctgtgaattatgaatgttcttaatggcatctagaataatgaatccttttcagaaggtattcagtttgctttgcccagaccaatcagaggaatcaccttatgaaatatatttcttaaataataagacttgaaagtgaaaattactccttggtccatgagctgcagaatggatattgtgttagcaggcctgcaaacaacattgatctccttgtacatctccatcagaagtctttaagtgaccatgtgcattgtcaatgggcagtaatattttaaaagtaactttttttttttctgagcagtaggtcttaacagacatgctgtcatctaggctttgttgtttcatttatagagcacagacagagtagatttagcattattcttaagggtcccaggaatttcagaatggtaaacaatcattggcttcaacttaaagtcattggcccctaacaagagagctggcctttcttttgacatgctgaagtcagacattgatttctcctctctagctatgaaagttctagatggcatcttcttccaatagaaggctatttcatctacattgaatatctgttgttcagtgtagccactgtaatcaattatctcaggtacgtcttctggataacttactatagcttctactgctatatcagcacttgctgcatcactttgtacttttatttttatggagatgacttcttttcttaaatctcatcagtttacccctgctaccttcaaactcttcgtctgcagcttccttacctctcagccttcatagaattgaagagaattaggggcttgctttgtattaggctttggcttaagggaatattgtggctgatttcatcttctttatacagactaataggctgtttcactttcctcttgttcatttgttcattggagtagcacttttatttccttcaagaattttttctttgtgttcacaagttggccatttggcgtaagagccaaatctcagcttttgacatgccttccttactaaacttaatcatttctagcttttaatttcaagtgagagatatgtgactcctcacttgaacccctaaagaccattgcagcattgttaattggcccaaattcaatattgttgtgtctcagaataaggaggcccaaggaaagggaagagagttgggggaatggtcagttggtggggcggtcagaacacacacaacatttttccattaggtttgccaccatatgtgggtgcagttcatggtgccccaaagcaataaatagtaacatcaaagatcactgatgacagatcaccgtaacagagtaaaatgaaacagcttaaactattatgagaactaccaaaatgtggcacagagacatgacatgagcacatggttttggaaaaacggcaccaacagacttgctcagggttgccatcaaccttcaatttgtaaaaaatggagtatctgcaaagtacaataaaaatgtgaggtatgcctgtacctgtaaaaagttgaggaaaagcagaatggtggtttgtaactgtcacatacaaagcgttaatttagaagaaggcattggccagaaatcataaaagcaaaaatcataaataggcctttagattttactcttgctgtttaaataaaatcattttggaaagtatttttccagtattgtttccttaagatcactttacatacacagacaatccttgacttactatggttccaacttcgacagtttttttactttacagtggtgggaaagtaatacacattcaatagaaaccatactttgaattttgaattttaatcttttccggagcttggcaatatgtggtatgttactcttgatgctgggcagcaacagtgagccacagctcctggtcagccatgtgatcacagggtaaacaaccactctacagtgtactgtactgctagatgattttgcccagctgtaggctaatgcaagtgttctgagcacatttaaggtcagctaggccaagctatggtatttggtaggttcagtgtattaaatgctttctcaacttaagatattttcaatttttgatggttttattaggatataagttcatcagaaatcaaggaacatctatacttaaactgcttgtaaaactactgtagaggccgggcgcagtggctcatgcctataatccctgcactttgggaggccgaggcaggcagatcacctgaggtcaggagtttaagaccagcttgaccaacatggagaaaccccatctctactaaaaatacaaaattagccaggcatggtagtgcatgtctgtaatcccagctactcgggaggctgaggcaggagaatcgcttgaacctgggaggtggaggttgcggtgagctgagatcgagccattgcactccagcctgggcaacaagagcgaaactcagtctcaaaaaaaaaaaaaaaaaaaaaccaaaaaaaactactgtagaactgcttgagtttgggggcattattttctttggtaaacccagctgctttttgtagttgtgtggtgctttgattgactaacatgctaaaaatgctgccagtctccttgttaaacatgttaaatgtcatattcatcatagagtaagaatacaaaattggagtgacctattaaaatattgctttgtatgtgtcctacttgaaaaaatactctgaatttatctacaaatgcgctacaggcgggctttttacaaaatgcctttatgtacaaacttttgggaatatggctttaaatggaagattatatggaaaacatcttcgtaaaccataaagcaattatctacaagtatagaggctgtattaaaaaacaatgtatttgacttctacgagcacctactagtaaatcactttttaggtgtttaaccatcagaaatcttaaaatcatggcacatgcaaacttaaatttacaaattaaaaaacattagtgagaagtataatttttagcaaaagaattcataagctcattgatctcccccaagccagctccagctgctgcacaggtgaaacagcagtgatttaattttgtttcaacacagaaaacttacggcctgcccatggtcatagtgggttttatactgagtaagaaggaatgctagtatgccaaggatttgcttcccagagtagtaagacagtagttgttgtaaaggcttcagggtgtaagaaaattaaattttaggccagatgtagtggctcatgcccataatcccagcactttgagaggccaaggcaggcggatcacttgatgtcaggagttcaagaccggcctggccaacatggtgaaaccccatctctactaaaaatacaaaaaaaattagccaggcgtggtggcacacgcctgtagtcccaactacttgggaggctgagacaggagaatcactggaacctgggaggcggaggttgcagtgagctgagattgcaccactatactccagcctgggccacagaatgagactgtctgaaaaaaaaaaaaatgaaaatttagtctcagtcttcaggcattttgtatcttatattctccaaatgtcagcttgtctgtgtaatttataagtaacgtaggctgaaaggtaataggttgtgataggctacaagcaagaaaacattgggactgggcacagtggctcacgcctgtaatcccagcactttggggacaccaaggtgggcagatcacctgaggtcaggagtttgagaacagcctggccaacatggtgaaaccccatctctactaaaaatacaaaaattagctgggtgtggtggtgtgtgcctgtagtcccagttacttgggaggcagaggtgagaatctcatgaacctcagaggcagaagttgcagtgagccaagatcatgccattgtactccagcctgggcgacagagcaacactgtctcaaaaaaaagaaaaaaaaaagaagaagaaaacattggaatatgatcagaaaaggtctggttgtgtcaagatcagacctttttaatggagaaccattgatattccacatagatatgcagttctgtgtattttgtcacttgaaatattgaaaggattctggttgtctgtcactttgtctggcttgtataagctcagtttcccattctcttttgtgttctttgcattcttggcacagttcagcggaccaggagaggagaaattgaaacatgctgctgctaccttttgcagtaaccaacctttcgccctggaaatgatcaaatctcgtcagaaaaaggattctcgatttcagacttttgtgcaagtgagttgagtgagtcatgtaagaaaaaaaataaggcaagtttttatcaattatcagataaactgggggaattctgactaagacttttacaaagattacatctgtgttaactttttttttttgagacagggtctcgctgtgttgcccaggctggagtgcaatggcacaatctcagctcactgcaacctctgcctcctgggttcaagcgattctcctgcctcagccttcctagtagttaggattacaggtacatgctaccacgccctgctaattttttctatttttagtagagacggggtttcaccatgttggccaggctgggctcgaacacctgacctcaagtgatctgcccacctcggcctcccgaagggattacaggtgtgagccactgcacctggcccacgttaacatttttaaaagcaatacattatctcttaaattcctggaaggtacaaaaatgactttggaatggtgaagaataataaaaaatatatgtcaggattaaaatacttaatatagaaatccacattgccacgaggcttttatcagtaaacaaccgtatgctctattaagagaatattgtcaaagcatgagaatgggtttatccagggaaaaacgtaacagcagccacactcattggggtatatgaattaagggttggtaaactatggccgacagaccatatctagtctgttacctgtttttataaagttttatgtaaatacaaacatggccgcttgacagatttctcacagttgttgtggtgtgtgggtatggtttagcaggttcctcccttgagagtttgaccaggctgagatcacagcgtcagcgggagctgcagttttcatctgatgctcgaggttctcttctaagctcactggttgttagcagagttcatttctttgtaaatgtataactgaggtcctaccttgctagctattggctaggaaccagtttcaactcctagagaacagagagatctctgccatatggccccattaggcagtttagaggtggatgtttgctttcttccaggccagtaggaatgtggctttctgacacagatttgttttaaaggctcctctaatgaaatcaggcccagccaggataatttcctttcttatgatctcaaaatcatgtggtggcaacctaatcataggtgtgatatcccattgtaatcacagattccaaaaatgttcatactcaagggcataggattacacagagtatttacacaagaggatgggaaccttggaggccatattagagttctttactacacagagccttgttcattcacttatgccaaaacagtagagctgaatagttgtgagagagactatatggcctgcaaagcctaaaatatttactatctggcattttactaaaaactttgcagaccactggtatagatgagctggcatactcgactggttatccattgtgcatacttggaatggcagataacaaattagctaaccaattttggtaggaatgtcaatcataggagaatggacctagattttctgaataggtgaagataaaactgtttcaacacaaggaagcgatacgtagagctgcttatggatgctttcagtccttccttaaacagataacaagccattcatttagtaatagaggctcccttcccccattatgtgattaaaggagaaagcagaagtatattgtggcaatgatatatcttggcattttttaaagatcttgatttaataaccagaactgtgatgcattaaaccctcacggtgaatacatggtacatgtataagttcaaataagaattacagattcacttatttcactttaattttaggatgctgaaagtaatccactgtgtcgtcgtcttcaactgaaggatattattcccactcaaatgcaaaggcttactaagtacccacttctgttggataatattgccaaatacacaggtacagcattttcactgaaataaaaagcttaagaacaacaacaacgaaacacccaatatcctgtaaataatatcttacagcgtcctgaatggagttggatttccaaatagtatgacaagattttctttttttttttttttttttccttttttgagacagggtctcactcagtcttgcaggctggagtgcagtggcacaatcatagtttcctgcaacctcaaactcctcggctcaggcattccttccacctcagcttcccgaacagctgggactacaggggtacaccaccacacttggctttttttttttttttttttagcaagggtctcactatgttgctcaggctggtctcaaactcctggcctcaagcagtcctcctgcctcccagagtgctgtgattataggcatgagtcaccatacccagccaagattttctaacaagatatgatctagtcttcttcgggctgtttgatataatgtactccattagtagctttagtacggggtatatcaaactatgaatcatagaccaagtcatgctcactgtctgtttttgtaaataaagttttattggagcacagccgtgctcgtctgtttatgtactgtccctgattgcttttacattataacagcagagtcgagtagttttatcggtgcccatttggcctacaaagtgtaaaattatctggttcaaccatccttgttctagcctgcatcatttttgctttgaagaaggttcatccttggctgaagagatgtttcatggatatctatcaatgacttttattaagccaaatcaatgcggtgtaattccaactctcccgttttgaaacatgaaatgaatctgtttctcagctgagctttaggttcttatacttagctctcattaataatttaatgcaactgaaatcttgtttcttgtgcctgagaatttgaatgcataagcaggaaattttaaattatggtacctggtaacaaaagtggtttacactcatacatattaatttttacactttaatatatctgctcagtgtagttagactgtggtttggaggattataattttgaatgttctgattttggtcttctttgtattatagacatgacatagcctcaatacgttttgtcttgttttgttttgttttgttttgtttttttgagacggagtctcgctctgtcgcccaggctggagtgaagtggcacaatctctgctcactgcaacctccacctcccgggttcaagcaattcccctgcctcagcctcccgagtagctgggattacaggcgcacgccaccacacctggctaatttttttgtatttttagtagaaacaaggtttcaccatattggccagactggtcttgaactcctgacctcaggcagtccgcctgccttggcctcccaaagtgctaggattacaggcatgagccaccttgccttgccgcctcaatacgttttgatgaatttcatcttcttttaatgtaatctattttctttctttaaatataatctcaaattcaaagaaacttgttttggaattattttgaattgtgttattaaaaaattttgtttaacaagttcactggacataattatgtaggctatgcactgtgaaattctgaggggagaagggatttccatttatattatttacaaagtaaatgagacctgcccttctggagtgtatagtatagtggtcctggtacttcacgtaaagcatctcttcttggatttcgggttctgtactgtgatttctttttaaagattagaatttatgttttaaagtcctgttataagaagttttacctgtccaaagactgcttgaattgagactctgacagaggctttaagctggtacaaaaatcttcaaggtcttaatatgctcttaaaagtattgaaatgaaatgaaatctcatttacatatattttatggttttttgctcagttcttttacattttggatttctttcccatatttagaatggccaacagaaagggagaaggtgaagaaagctgcagatcactgtcgtcagatcttaaattatgtaaatcaggctgtcaaggaggcagaaaacaagcaggtaaaaaaggaaaacaagaaggtacaggatgacattgggagaacattaaattaatattacctggaatctgtgaaatagttgttaaaactatcattacctaatggacagggagaacatttgtttactgttcgcatagtaggcaggtcaagatcaatctgtgatagaatatcggagttgtatttgactttttgaaacacctcaagctgcttgtttgctctttcatttatctcttcattcagcagatatttatagaacatctactgtatgctgggcatagggtacagagtagttgagaaaatgagtgcaatatctgcccacactgagcttgtttgctaggaggatagaaaggcatttaacaggattatagtgcaaatattttgtatcagttgtgatagctactatcaaggataatttcaagatgctacgatatataactatggggcctagcttagtttggggatgttaggtggtgcctattagagaaaattttcttgaggaattgacacttgagccaagctctgaaggatgagtggaagtgaaccaaaatgatgtgaagggtgcaaccctagaggtagaggcaatatataccaaagtcctgacggaaaaagaaagcatggtctgttggaagaattgaaaatttacatgagtgtggatcatgcctaaaaagcaaagtcagagtggcataaaatgaggtaaagtagaccaaggccaactcataaaggccctagagatcaggttaaagattttgatttgtcttcttaagtgcagtaggaattcagcatagacaagtaagaatatagtgttcagattttcattatctgaactagtactctatggagaatgagttgaagaagggtggtggatgaaagagcccatttattaacctcttgcagcaatctaggatagatgatggcagcttagagaagttggagaagtatttagaaggtaaaattgacaggacttgatgactgatttgaagaaggatttgaaggaaaagtgatgtcaagaataaacccccaggtttctggattgcatatttggatggacaggatgagtggagaagccccacgtttgtggggaagatgatgaggtcactctgggatatcaggtagacatgcacagtaagcagttggctgtatgggcccacctctaagaggaccatgttgaagataaaaattcaagattgtgagcatacaggggctgattgaatccgtgaacacggatgtagtttcttaggagctgagtatgattacaactctcttggtgaggctgtagaaaaactagtactttcagctgtgctgttcagagtgtaaaatgataaaaccccagagggttatgtagcaatatttatctaaattaaaactctgtaggtacccttatatctaccttttgactccgcagttctgttcctagtgatttgctcaagagaaatgaaccatattagagttctttactacacagagcctgttcatttatgtattatctgtggctacttttgttccaaaacagtggagctgaacaactgggagagagattatatggcctgcaaagcctaactgacattttactaaaaaccttgcagacccctggtatagatgagctggcatactcaggctggttatccattgtgcctgccgggaatggcacataacaaattaactaactaactttagtaggaacaccaatcataagcaaatggacctagattttctgaataataaaatatatctttatctgaagataaagatatacccacaaacagacttagaccagaatgcttatagcaactttattcataatagcgaaaagctagaaacagcccaagaatttatcaacagaatggataaaccaactgtggtatagttataaaatagaatgccctgagtgataggaaaggaatgtaccactaaggcacacaacatggatgaatctcacaaacatgctgagtggaaaaaaaacagatgcaaaagagtacatacctatgattccatttatatgaacttctaagagagaccaaactattctatggtaggaaaaaccagaaaactggttcccattggggatgaggaggtagaaattaactgggaagaagtatgaggaaactttctggggtgatggtaaaattttctatcatgatagaagtttaggttacacaaatgtgtaagcacttgtcaaaattcatggaacatacacttgaaatgtgtgttctactgtatgcaaattttacttttttaaaaagaactgtatggatgtttaaatgtttagaggtaaagtgtacttatgtctgtaatttattttgaaatgcatccaaaaaataagatggactgatggatagagggatgaataaatagatatatgataaaacaaatagagcaaatgttaattgtagaatatagatggtaatatataggtgttcactatgctcactcagacttttccatgtatttggaaatgatattgtgggggaatgtacataccctttgatccaacagttctggaaatttatcctacagatatcctacatggatgtacaaagacatatatttaagtccactttattacagtattgtttgttacagaagagttgaagtaacttaaatgcccatcagtaaggcgtaatgaaataaattatagtttattcagagagttttacatcctgtagtcatttataaaaaaatgaaataactctctatatgtgctaatgtggaacagtccccaagatataagtcatacaccacacacacacacacgtgggggaatacgtatatgaatgtattctaccatttcaatgaggaatacatataggaataccaaaggaatgcatatatgaatatattatgctaccatatcttgttttaaaaaaggacatatacacacaacatgcacaaagacaagcatacttatatatacatatataaataaatacatatctgtttgcatagaatttttctcaaaggctacccaagaaatggatattagtgattgcttctttagggaaaattgaggggggtggggcaataggacaaggttagagggagactttttattttttgccttatatagccatctgaattttgtactgtgtgcatgatttacatattcagaaaataaatataagctaataagagaccaatgactttgaaaagaagattgagaaagaaaagccaaagaggcaggaggaaaactaggagagtatattatcaccaaagccacgggaagagagtgagttttcagtcctgtctagcattgcaaagagctcagtaaaatggagattttttttttttgagatggagtcttgctgtgtcgcccaggctggagtgcagtggcgtgatctcggctcactgcaagctccgcctcccaggtttgcaccattcccctgcctcagcctcccaagtagctgggaccacaggcgcccgccaccatgcccggctaatttttttttatttttagtagagacggggtttcactgtgttagccaggatggtcttgatctcctaacctcgtgatccacctgcctcagcctcccaaagtgctgagattacaggtgtgagccaccacgcctggccaaaatggagattttaaatgccaagtttgattcagaaatagagaggtcattaatgaccaaagcactaaccttggttccaccctgcctaattttcagcgcctagaagattatcagcgtcgccttgatacctccagcctgaagttgtcagagtacccaaatgttgaagagctcagggtgagagatggtctaatcataatttaaaaaataaaataaaatttgctaaagacctggcaggtaattaacatctcagtgggaatatacgtcacctgaaggagttcttgtatcgtagattatctgtatttatgattttttttgctgccttttaaatgcttgatctgtatgaaattagtttttcattagaggaatatcttgcataaaactgtaatattacatgacagcaattggcaggagactaagggacactaattattataaaatttaattttattgtgttctgtagtttgtttcagacagggtcttgctctgttgcccaggctggaatgcagtggtgcagtcttggctcactgaagccttggcctcctggactcaggcagtccacccacctcagcctccctagcagctaggactataggtatatgccaccatacccagctaattctgtgttttgtaaagacaaggtctcgctgtgttgtcaggttggtccagatttcctgggctcaagtgctcctttctcagcctcccacagtgcagggattacaggcatgagccactatgcccagcctgtgttctgtagtttaaataagggtaggactgtttggtaactttccagatcatttaataacacaagatagcatactattttctcatgaggctcttcagaagcataaaagttggaaccattacaggaacgatagtaaaatgtttactaattgccacttctagtatgtgggcttatgtgttaactttttcggattttaagtgtttttgtaccatttcactaggtggtggttttggcagatttatttggtggctgttaaaatagacttttatgtcatatattaatacttcgtcaacaagcacgtaaatgtgcttattccccttagcttccaaagaatgagagttttctagagctgctaatactaaaagatgattctcttactaataagttgttaatatttagaccaagtctgagtagtacctggacttttcatgagtactatttcttagaactttctttgaaattagagccttggaactcagaagccactttcttatagacaagcatatgtaccatgctcatccagttattcataggaaaattaaaggatacgttgagaatctagtgactgaatgtttgtaacttgatcttcataatctgttatcatctgtttagagtgaggtttgaagatagtactcctgaatgttcttctgcaagataccttttcctttttagaaaattgtatgcagattactttaatatggcttttgtgccattttcaagaactgacaaatagcaataatgatagttgaatgtaaatggtgtattttatattaagaatttctttaaaagagactgtattatatagataatcatgttactgagtgcttggaaattatttgtgcatgattttctttattttgccagaatttggatttaacaaaaaggaagatgattcatgaagggccattggtttggaaggtgaatagagataaaactattggtaggtctgatattgtcttttagttttggggagagtggcaaaagggaaggaataggaaagtttcctatgacaaagggaagaggagagaaccattctctcagcagtttgcagtgctacctcgtgttatttgtacatttgtagatctgcttgtgttatttcattatatgtaagatgtgttaaatattcatttaggaatgtagtggagaactgatttagtcctatttccatcattcttatagtctagtgagtctttgtatgctttgtaagctttctttagaccagtacatcttaaactgtctgtgatgaggaaccgtttttgttttttcagaaacaaggtctttctatgttgcccaggctggagcacagtggctagtcacagatgcagtcatggtgcactgctgcctcgaactcctgggcttaagggatcctcctgccttagcctccctagtagccgggactataggcgcacagcaccacacccagcttgttgttttttatttcctattggtcacagactgacacttcagtgaaataaaataaaaatgaattactgaaaatgaaattttaaaagataatatacaagtcaatttttaaaattttgtagctttaacagaaatagaattcctctgttgaatcattataaagttaatcaaacgcgtctccatttctgtacttaccatttttttctgcacttttatttctagatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacaggcaagtatgtccactgaaggatactaatttccagattcattgtgaagttgcataagatactcggtgctgtctcaataacacaagtggcatagagtcttgctatttttatattcttaagcaaattacatgaaatttactgcttagaaagagacctaagagtttataccccaaagttattagggtgtctcgattctgtgaacagttttctgcatttgaaaatttttatgctattactttggttctttatgttcaaatcattgatagatcccaatgaaaagcctttcatttagggtggtatgttttttgatttggtgagaaaaaaatcaaaaaccaaagagacggatgtagtgttgattaaaaatcaaatttgactggcaagttatattttaactctattaacaacggggtcccttttaaaacttgttagtttcatggtggcaaaataaatttgtgacctcttttctccactactcactgaatattattaactaacaacttagcaaaagtgcagttcaaaataaatgcaaaagagtaatagcatttaatctggtaatttggatttatttattttttttcttttgagacgagggtcccaccctgtcacccaggctggagtgcagtggtacaaccttggcacactgcaacctccacatcccaggctcaagcaattcttcaacctcagcctcctgagtagctgggactacaggcatgcaccaccatgacctggctaatttttttgttttatgtagaggcagggtttcgccatgctgcccaggctggtctcgaactcctgagctccaagcggtccacctgcctcggcctcctaaagtactgggattacaggtgtgagccaccgtgcccggccagtaatttggatttttgacatgcttttagcaaagtttctagtaaattattgtggaattagtgctaattcgtataatctttgttttattgaagtacaataaatatagtacaataaatacgttaatatggtaagttgcacaaattttaagtgtacatcttgatgaattttaaagtaaatatatgtaacctttatctagtttaaggggcagactatttcaagaccctaaaaacatccctcatggcctccccaggtcatagtattagagtaatcttgtattgttttttccagataacaaagctttattcgtcatttccatgtcagacaatggcgctcagatttatgaactggtggcacagacagtttctgaaaagactgtgtatgtatcagatatggctaccttgctatagctaatattttcattatcccaagcgtaatattccataaacttaactttgtttttataatgtatggaaaccaagcacttcctctgtactcttttagagacgttctactatgaacttgttcttttttaggttgatgccttttattttgattctattctgaaagtttatttcctaaagaaaaaattgtgcaaaatgtcaagtgaagtttttttaatgtgtccatagatttctcttaaggtatagttttggactctcgccttaatagtgtgttgccaaaataaagatattctctggcagagtgggttttgttgttgttgttgttgttgttgttgttgttgttgttggttgatttggtttttgtttagttttgctttctgagtatatttaaaggatatttcttttttcttttttgtattttggatttctttccaactttctgaagctggcaggacctaatctgtcggatggctgcatcagtgaaggagcaatccacaaagccaattccattaccacagtcaacacctggcgagtgagtgttcctttgcattgtagtaggacttattttatgttttgggttggaaaagactaggataattattatgttttgttgcgatgatgtttagatacctcaggaaggtaaaagtttttttttttttttttttctctacagaggagataatgattaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagataggcgtatcacctgaggccaggagttagaggccaacctgaccaacatgacaaaaccctgtctctactaaaaaatacaaaaattagccgggcatggtggtaggtgcctgtaatcccagctacttgggaggctgaggcagggagaattgcttgaacccaggaggcggaggttacggtgagccgagatcgtgccattgcactccagcctgggcaacaagaccgaaacaccaaaaaaaaaaaagaaaaaaagaaaaaaaagaaaataaaataaaatgcaaagaaactttaatactgtttggtttatgcaggttccagcatcagagattcagtttaacaaactttgcctttgagccttctgtgtgtcagtataacactgttctaagtgatgtgtatttttcttaacagatgatctctgtagtttatggattgttttttttttttctgattcttccctgaatgcttcatgttaaaagttaaaagctttgtttagatatagtctaccttttctattccattggacagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaattgtaagttttattcataacttattacagatacttactaagtatgacactcatgtgccatccctaaagtatgtggatttatcaaactccacttattcttctagttctattgtggagattatagtattctctacagtggcccatgccacaggcacacacacacatgccactctgttagctccccacccccctgcctggttcagaatcactgttaaaatgggaggatagcatatctctcagttgtattgaggtgggaaaaaggctgagaacaatttctttggctggggagaaccacttgaaatttttaaaccagcgtatgactaaaggtatgaaaaaagattaatctggctgaaagcggtggaaggatttgaatggaaagaggtatggaatggtgtacttactaaataagctattataatagtctggcctgagactaaaagagtttggactagaatgttatcagaaggaataagaagaaactgagaagtcatcaaatgcttaaaataattgacttctttgaatgtgaggtcaaaggaaagggaatatttagagataatttcattaatctagtcagaaataagagtcagaaaaggactaccactgcttcccccacctccttccattgtactttcttttttctttcttttgatttggtagaattataggctcagttttaaagcatgtcaagattaagataatgaatgacaaaacactaaaaagtgagtaactagcaggaagttagagttttaggagtgaaactttagagagaggttaggaagagatagagatgtgagcatcagagccatgagacttcctggcatctctcaggaagtgattgtagagcagaaggacagaggatgagagacctaagtggaacctgttgcctaaagaaacatgacagacattaagctagtgatgagagcagagaattggttatttaaaacctacaatattttttataccttctcctgaattaacagtcttaataatttctgatggttggaataacattgtcccaataactctatcattgtctgggtgacctcatagcatacacttggcccattcaaaattaaattggttcttattttcagtaaatgtatgtatctcataaaattagaggaaataatatgcatatagtgtctggatctggaaaaagcagaacttttttttagctttttctgtctagcttaacacagcctttcaacattcttaagaagtacctttagggtattattctagttatatagaagaaaaaatagaggcatgatattggttattgaggagttctaaatagtagtatctccctattcagaatgcttagatcttttcaagtttagtttaacgttaaatcttctctaaaagatggtgctttatttcatcttcaaaacaaaatggaaaatgattgtatgaagtaagatgattgtatgaaattaataattaacattttaatatgtcattaaaagatactttttaaagatagatcattggtaagtcagctaatttaattcttgcagcctgaggttatagttgtgaatatgttttttttccccctccttcctaaatcgtttagtgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggcaagtatctttcacacttaaactttgattttgattttgatcattgttaactgtcctgtattttgaaatggatgttgtattggtatccaggtgtgtgtgtgtgtgtgtgttcacacatgtgcaatatttattccttcatttgataaatactgaatctactctgtaccagacctcatcataggtgctgggagatatagcagtgaataaaacacagaaaaatcccatcttctcatgaagctaggggaaagaaggatggtaaataagtaaacaaataaatagacttcaggaagtattaggaagaaacataagtcagactgaggggacggagagtaatgaaggcaaacagggtgatcagggattaggacctccgatgaggtagcatttgagcagagacctcaatgaaatgagggaataaagccgggtgggtacctgggagcttactattccagcagagagcagagtggggcagaggctttgtgtcaaagagcaagctttttgtggtgatcgaacactggatgagggagacaatggcaggagatggggcaagagaggcgtttggcaggggaagtggtagcaagatcatttaggcactgtagtttccagctttaaacttttgaaatgaaattttttggaaattaccatgaaagtttgcagagtttagctttcatctgaagtgaggaaattctgatgtacctgaaactaaactcaggaattaatggcttttccctctcttaataacttttcaagttgaagttgtcagcacactatgctatttctgttttctaatggcagcactggtcttatcaaactattctgtctctatccataggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaaggtacctcatacttccacatccataggacttggttgtaagaaacatttagcagaggggaagaatagggtgatgaaaatgctgatgtcaataaacttgttcaggttctagatttctttgactattatccatgaataggcctgggtaaaaagttgagattggcattgtttatctttttctttctttctttttttttttttttttgagacggagtctcgctctgtcaaccaggctagagtgcagtggcgtgatctcagctcactgcaagctctgccttccaggttcacaccattctcctgcctcagcctcccaagcagctgggactacaggcacccgcccccacgcccagctaattttttgtatttttaatagagacggggtttcaccatgttagccaggatggtctcgatctcctgacctcgtgatccgcctgcctcggcctcccaaagtactgggattacaggcgtgagccaccgcgcccagtcggcattgtttatcttttgactatcacaagagcagaaaaagttgcagctctgtgaactgtgtgtttgtatgggtgtctaagtttaagaacctgaaatgcttcgggtagttggctggcctctgtcagacatgaacaagaagatgagataggtagggtttatgtagttatgaatctaggctgagaaatgctatgactttctgtagcctattatctgtgactcattaggtgacattggcagcttcccaaatcctatgacagatagaaattggcttcagtggctcctgtaatctaaaaacatggtcatgcatgggatttttgtagattggtaattgaagatgtcactattgcaaaactgacttgtgtggcaatttccaagagaaagacctatcttaaagttttccatcagaggcagggcacggtggctcacgcctgtaattccagcactttgggaggcaaggcaggcggatcacgaggtcaggagatcgagaccatccttgctaacacggtgaaaccccgtctctactaaaaataaaaaaaatcagccaggtgtggtggtgggcgcctgtagtcccagctactcaggaggctgaggcaggagaatggcatgaacctgggaggcggagcttgcagggagctgagatcacgccactgcactccaacctgggtgacagagcgagactctgtctcaaaaaaaaaaaaaaaagtttgccatcagaaaacacagcttccagagcccaaacattttcctcatgacatcatttacaccagagacttgaggggtagatttaagtatccttagcctttgagttaaagactggtctcccttagtttctcttttaccttcatataattgatttttccctcttcatgttacttattttatgtagtatcattctgtagctgatgagatatcgacaagcccattgaggacaggtcggttcttatatacagtcatgtgttgcttagcaatggggatatattctgagaaattcatcattaggcatttttatctttgtgtgaacttcacagagtgtacttacacaaacctagatagaatatatctttatttacatagattttttcatatggaaagccaaatctctcaacactattactgaatattagtcatttcccctacctgatcagcaatgccattattaagtgccacacaccaggtttctacatgtgctccataataatcttttttttttttttttttttttgagacagtcttgctctgtcacccaggctggagtgcagtggcgctatttcggctcactgcaacctctgcctcccaggttcaagcgattctcctgccttggcctcccaaggagctgggactacaggcaccaccaccatgcccagataaatttttttttttttttaaatggagtctcggtctgtcacccaggctggagtgcaatggtgcaatctcggctcaccgcaacctccgcctcccgggttcaagcgattctcctgcctcagcttcctgagtagctgggattacaggtgcccgccaccacacccagctaatttttttctatcttttaatttatttatgtatttatattttttgagacagagtcttgctctgtcgcccaggctggagtgcagtggcatgatctctcctcactgcaagctccacctcccaggttcacgccattctcctgcctcagcctccccagtagctgggactacaggcgcctgccaccatgcccggctaattttttttatttttagtagagacggggtttcaccatgttagcctggatggtctcgatctcctgacctcgtgatccgcctgcctcggcctcccaaagtgttgggattacaggcgtgagccaccgcgcccagtcccagctaatttttataattttagtagagacaggatttcaccatgttggccaggctggtctggaactcctgacctcaggtgatccacctgcctcggcctcccaaagtgctgggattacaggcgtgagccaccatgccccacccataataatcttaagggaccatcatcatgtatgcaggccgccatgtctttatgtgctgcatgactatagctcatgcacatgatgacgggaccatgtccagggtgactcctgggggtgggagaattgcatctatggttaccacctctactttctttttacatgggaaaatactaagttattccttcagtggagaaattggtaaaaggaatgaaatttacttttttcttcccactaatgaaatttttaatgatgaagttaatatttttgaaatttgggggcttgtacctgtaatgtaaaaagggcttcttttctgttttctgaagtttttgttttgttttgtttcattacgtttgaataaaaaacctatgggttttatttcacagaaggtggaggaaagttacaccattctttgccaaaggctggctggatcagccctcacagacaagcactcaggtatgtaaaagttatgagttccagactctagactaatcatcctacactgaatgaaatgacttatcatactttgaagtgaaaaccttctgagattccatttctcttctgtctttaaagaactgcctgtttctaaacatcagatatcaagcggaagctcatgcctgctgactctactcttctctaagaggaactgcagttgtcagttcccataccatcccctcttctctctcttttcaccttttcaaagcagaaggcagagcagtgggaagcctggtaaatcacagattcggtgtgaggcttactggtactgctgtgactccctagtgtggaggatttggccttattggatgttggtgcacttgcctctgctgacagtgtggctggtgtctcccctgactgcagatggatttgtgttccctgcagcagtttatactcatctgcttacatactgattcagaaacaaagattgaaccacgcccacagatgtcatgggtattctttgcaatgttagtatattctttttcttaatatcatttccatgtatctttattcttctcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 5 - DNA, 153525 bp, Homo sapiens
  source 1..153525: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggttggtatgaattcctccttcgttcggcctcccggaatcgggcccgacctagcaggggagtcggtgattgcagattgcctttggccagcgaagttgacaggcagaggaaagagggttgtttcggagctgtgcagttagcctggggttgctgccgagttatccagttgattggcttttggaaatgtaatttttccggagagaaacttcccttccgattctcagagaagggggaggcaaaaccatgattgtggttttccgcctgtagtgtgcattaggattgtgtactcgtctggaaatcagaggagaaggtcattttaggtgaaggtcggtgcctgaagtcggctcggtattggtgtattatttatcagctttagccgtgtcctgcagtagattctcaagacaattacattttaggaatttctacctgtgaacttaatgttgagcctactgcatggtgatctgggaacttgatctctttcagatgttgacctgcacggtgtttaattattatctaataactttccagaatgttgacattaccagtaaatcacaggttcttgctggaagcaatgtccaggagctgaagaaatgagggtaaatcatggggtttgcttttaattcttgtatttaaatatttcgtcttccagaaacacttggcgtttaagagatataagccgtaagcatagtgtaagcgcgcagctgaatttgttgagttctgtgtctgtcctttatagcacctaccagtgttgcatggtggtgggtggcgaattgagctagaccatgtgtggttgaagtgcagtttgcttatcctaagttactcttgtttatagggtaagggataaaaagcatattgattccttgaccacatttcattctcaatttaattatgacactgcatgctagtcccaaatttgtcagcttgctttatttttaagtcagtcttcgaattattacaccgtgaaaaaatagatcaagtaactgaattagagggccaaagctctttgatgaaaagtgcaacaatagtgcttctgcacaaagtagtcttaatttcctaataagagttttacccaattgtaagactcatttgttgattttaaaagggccaaattccattatcataccataacagctactccagaaacagaacttcctcttcctgttgatgctttccagcatcacatgaatgttcacttaaaagagtctgttaaatatttaaagtatttatatttactctttgtgtatttttcaaagtgggttttcattttcaatgaaataatttttaacttttccaagaatacacttaagataagtattgacaatgcttatcttactttcttctggttatccccatttttttcctttcagggtgttttgcttctgagaaatcacttttacgggtgtggggataattgttttcctgcttcattcaattctcgctctttctgttgagcctgtaaacaaaagtcttgctaggaactaatgtaatgttggttttcattgcgatgctgaggtgtttaatttatggaaacagaacggactcattccacacacaagtgagtgaaaagccctcaagtaatggtttttcttcagcattgcttctcagggattttccttgtcttctcgttatcttggaaatagaatcttggaatttgtatcctctttataacgtagatggcatataaacattcaataaatatgaaattactgaaagcctgtttcttttctttttcttttttttttttttttttggccaggcactgtgcaggcacaagagattacaaaatgaatattgtaagattaatctgcaaattggtttgggcattaatgttttttgaactggttcaggtgctgctgcctaattttacattttttttttttaaagaaaagaccttggaaagccaattaataagcactgctgagacctgtttcgtaggatttttttttactagggtctttttttattaagaattattcttatttgaccacatttaaatatattttgtaaatataaagcatccatttgctgttaagagagtagttgttcctaatatgaatatatgttggggtgaaatctggaggtactggtttagtattatttctctgccaaggtgtcttaacaaagttacgagtatataatagtttctagctttctgtcagccctacctcatccttttttcgtagtgtctaactcttactgtaggtatattttgctgactctagaactgttggaaaattaacagcaccagtgtagctttttagatagagatcctttcaagtttgaagtgctgtatgtggtatggctttgtttcgtagagtgtgcagaaccaccaggccagctgtgtgagttagagttctttcattgtggtgcttctgactacagagtctgtctgtcctcagttgaaatcagactagctggttttgggcgttgttctgttttgcagtttgtggcaggcgacacatggctgaacaagataagggttttattcttgtgttagggacgtgctggggctgggatggaattcagctatgtttaggctctgattggtcactttggatactcagaactctgttacatcctgttattattttgcagttaaatcaacacattaacttgctctcttctctttcccttcatcttttactccccagtccgcaccccttaaaacctaaaactcaaactttttaaaagactttaaactcaaactatgttcatggtagctattacttctatgtagtatatccaaacagctttaaaaaaaatggtaagcaatttatgagccctggagtctgtagttttcatcgtttagaatgagcacttgacaagtgtagaaatgtctgattgctgctttttagtctgcattgattgctgcattcagtcttaaaatacatcctaatcgtttccaatcctcctacatgtctttcttgtatccctgagaatttaggggtcctatagcaattggaatttcttctgagaggtagacaggagagaatgcccttttagtagactcagtaaatgatttcaggccagtgtctataacattgaattttcagggacagtacaggtaggaaagttatagggttcttccttgaaataaatggacttttgttttggctagggcttatgaattttgtagtttttgatttatagataaagacaggtttttgatacaatttttttaaagcactgaattcagctttgagctgtttaacttaagcagatttttaaagtgagtgtggaaacctgtgactttatatgcctgtacccagtaattaatgatacttttcattagtgatactttttctgtcaaaattgctgtataatggttttgattaaaaaaaaaagagctactcatgtttatatgttattttcaacgttgcatgagtcatctctcggcaaggtgaaattatttgtaaccttttcttgtaaagtcagccagtccataaatacaaaattgaaatgggggccaaagatcacagtgttagttttgtattcagttttatctttgcctttttagttcagtataaaatcttgagtcataaaggtatgcaatagtacattcacttgtacagttttacatgagtcaacatgcagaatctaaagtaactttttttgaaagtacagtgttgtagtcttcctgattaatggtacatttatatgatgttcatattcagtaaggtgacaagagaagctttatttgaaatcattacaaaaatatgttaaccttggaataccacttaacacattggtggtttccggttgttaacatgtatataccatcgagttaacatgtaggtttttttcttttttgagtcttgctctgtcacccacggtggagtgcagtggcgtgatcccctcactgcaacctccgcctcccaggttcaagcggttctcctgcctcagcctcctgagtagctgggattacaggcacccaccaccacgcctggctaatttttgtatttttagtagagacggggtttcaccatattggccaggctggtcttgaactcctgaccttaggtgatccacccgtctcggcctcccaaagtgccgggattacaggcttgagccaccgagcccagtggttttttttgttgttgctgttgttgttttttaactaagtttgagttttcagtttaaaaaatgaaatttgaggcaaacattcatggaatccataaatggtgaattttacatatgtttctgtggagcattgcgattccagggaaaacagttggaaaatatttcattgtacatatgtggttgcctcttctaaatgtcatccagtggtgggtatgaattgcttcccaaactgatacgggtcacagaaacagcaagataacatactggttcccagaggtaattgaagggactcttttgcatcatggttgtctgacattattagaaatgtttcttatatacttgcttgtttcctagaaattgaccatgacacattttcaagaatagtagcttaacttcttttggtcttttctgttaaaacttggttttgatgatgttcctgagctttatttgaagacatgctcctttcccttataataattacaggttttcaaaatagtgccatgtgagttaaaatttttaaatcaacaaaattatatttttgccttcttttgagtaaaataccatcatgtaggtaatgatatcctgtggtagtataattctttaacatttacaatattttcagttcagtacagggcagatcatgcttctgtcatttacactttaagctaattcatacagtttaagtcaagattttaagtcaagattataaaactagaaagggcagacccaagattttaacctagattttctggctctcaagtcccccattgttttttttcattttaaattattgtctttctttgtactgtatttttctgtgctattttcctttagtaactctccagcttgatgaagtcagttggatttttctcttacagcatagtttctagtaccttacccattctaattttaaatatctcttgaggataaagcttttgtcacttcctcaggagactgaagcacagtctgatagatcttgctgtcaggaagtttttcctgatctttacgtctaacttttcttttaagttgtcctgttacttgtatgtacttgctgtaccaggctaaataatgctctcctcccattttatgtttgtatgattctaaatgtttcagacggttattcattatcctttccggtccccttcccttactctttgcttagccaagctgtatgctttctgttgatccattgtctaaaaatcagcttatcttaatatttcattagctttttctcagttgctctcctactgcaaaaatatgggtaaagagattctcaaggtcattttgattcacttttattttagatagtctttaggatggatatgagatatgtcacagtcaaatgaaacaaatttatacaaacagcatgattaccaaatcaactaattaagcaattactcatgttctaaaaggcttttttacaaagcgattctttcaaatatgagtaccctcaatgtaacaaatgttatcaattctatgacaaaagggtagggtatagaaataatgttagccacctttgatggaaaatcatcttgttgcaatatgatgaaatacatcaggaagttgtttcttattttttccagtggtttttcagttcgttatcttaaattgtaggtcaaaacattcctcgatgtttggtttatttttaccttattgttttgtctcctcttatttccacatgttagtgaaataacaatgcttagcagtattttttttttcagtaaaatggatattgtgaaaattgaaatattttactttcttgctgttgtatttacaagaattgttaatgacaagacagtgtaacagaaaaagtgcatatttagattattataaaatctgtaagactgtagaccttttgaatactttattagcatattttctttagtactattttagtttcaaattattgagatagatgtccttgttttgtattttgctaatattaatattttgtattttggtaatactaaaatttgcaaacatgccaaatttagagcattttactttttcaacttagaatatctggaatcatcaagatagtcatatagggaagaccgctataagacagcttctaactccaatagaagcctatgaagctagtgcctggtcagaggctgtgcctaaattgcatgagtatatagtgtcgacttttagtaaaagaaaaaatacactaactttacctcttgaattagcatgcaccaatgcagtttagattcataccgaaacaggatcttttactaattcaaatgctgagtcctggtttttgagatcacagtcacatgacaggcctgggtggcttctcagtgtctagagacaagcaaatctactggccaatgaaaagtaggtttcctgtcttggactgcaagtaacaattcatgcagaaattggaactatataagagagcctggttttagttaatgctttcaattagctgcttgtcacactgctttttcttttggtgttatataacacattagagtcatttaaaggtacactctgatactacagtttttgtcaaatattacatataaatgttgattttacattcatatactcaaaagatcaaagaggactttgtagatcttttatggattcaaaaaaatgtagattattttgttgtagaaaaactggccaggcgcggtggctcatgcctgtaaatcccagcactttggaaggctgaggtgggcggatcacttgaggtcaagagttcaagactagcctggtcagcatggtgaaaccctgtctctattaaaaatacaaaaatgagccggaccaggtggcacatgcctgtaatcccagctactcgggaggctaagacaggagaatcacttgaacccgggaggcggaggttgcagttagccaagattgcaccactgcactcctacctggatgacagagcaagactccgtctcaaaaaaaaaaaaaaaaaaaaaaaaaaaaactggagacttcatcagcctctgaaggaatgatacctgaaattgatcttgtaatgcagaaagtggctatatgttatccagaagagtaacagataccccaaatacacttgctaacacaagaaatcctgtgaaggtgcttagacatacccttccatagattttagatgggttatctgcctatgttccagacacaagccgatatgttgtggtttgcccagtacagtctctgtggtttactgagaggaagtggttcttgtgggtgaaggtctgatcttttcagagattgttggtggcatatgcactgtcagcctatttcctgttttattggctgtttagcaagaccttcttagggcaagtgctgctgaagaggtatttaaatattttgtattggcaggatagatggttataatgatgtattattatatcactacttctcaggtgatatgagagttaaatgaatgtttgtgaagtgctttgagatcttaggatgaaaagtacagacatgttcttagtcatttgcaggttactgctatgttcagatattgctctcttgaagttaaaacttgttcatgtagtaaagtgttactctattaaacttgatttctgtaaccattcaagtgttgttttatcaccacaagagtcatgattagaatttttcccctttttttcctttctttcaatgctcctttatgattttaccctagaagagtttccttaatagattccttgctctagtactggttaaggcatatttaccaaacttaacacctagcaagcttgtccaacctgccttattttgctgttgttcttctgttttgttttgttttaggctttcagcagcctgaagccatggtttttagtttctgtctctagtgataaaacggaaagagggatgaggaaggggctttactggcccatccagaaacagaaactaagaacccatgactgtattctctcccttgaacaactgtaactagagcaaacctctttgccaatttaactggcatactaaaataatgaaattgtgagaatttcctttgagattagtaactgtaccatccatatacaaaacactatattgctttgctgaaacctgaaagtgagcaaactgatagaaatgcatataacaggccgggcgtagtggctcacgcctgtaatcccagcactttgggagaccgaggtgggcggttcaggaggtcaggagatcaagaccattctggctaacacggtgaaaccccgtctctgctaaaaatagaaaaaattagccgagtgtggtggcgggtgcctgtagtcccagctgctggggaggctgaggcaggagaatggcatgaacccaggaggtggagcttgcagtgagccgagatcgcgccactgcactccagcctgggcacagagcgagactccgtctcaaaaaaaaaaaaaaaaaaaacgaaatggcgtatgtcatactcctaaatatatatatatatacagtatttagccttggacgttaaaaaaattaacaatgaatgggggaaggctttatttaaagctaaattgttagctaatacgtgagttcttcaagggtataagaatagttcttattcatttttaagtaattatcggtagccttattatatttttattttttaatactgaaaagcagaaggaagaaaaataaatggcccaaatgatccaactacccagatgttgctgctcaggttaaacgcacacacgcatacacacacagaaaattcaaatcatataaaatggtataaaaaaaagtattcctacacacctgttagttttcataccttctcctcataggtaacaatagttaatttttttggtttatcttctgaaacatttaaaaatatataccagcctataattttattttttgcacctactccataataagtgtatctgtcttcttttgctaggttatgctgctgtagcaacactatcaaatttcagtggcttacaacactgcttttcttcttgcttatgctacaccttgtcagctgtggattgactgcagcattgcttcacgtttcttattttggaaccctggctcaaggagcatcccctgtctgggctgtgccattattgtggatgagggagagagcaagaaaacagatgcagacatacaatggctcttaaagctttcactcagtcatgttgtatgtcacatcagctcacatgtcagtggccaaagcaagtcatatggtcagagctcactgtcagtggggtaaggatgtatagtccttccacaggtggcattgcaagttgcatgataacagataaggctgtataatcctcttaaggaaagtggaggttaaataatttggaacaataaataatatagtctacatcaacaagttcagtaaatgcttgttaaatgggttatttggagtctatgaaagtttctttttttttagtgggaaattcaaacataaacagaagtacagagaatggtatgatgaacctcccttgttccctttattactccagcagttaatgtacggacaatcttggtttatctgttttctttccccccttctcactagattattttgaagcagtttttggatatcataatttcacttacaagtatttcactaagtatttttaagagataaagtctgaacgtgtgacttctcatagtaaattattactgtctgatagggtgaggtaatagtactatatagactgacaggtgtcaagcagcagagcacgttcatagagcgtatctagaatttgacagcctgaacttgttttgatttcattttgagtatttctggaggaggcttacaacagaatgccatctacttttccagcctctccctttctttctttctttccttccttccttccttccttccttccttccttccttccttccttccttcctttctttctttctttctttctctttctttttctttctttctttctctctgtctctctctgtttctctctctctctctctctctgtctgtgtgtgtgtgtgtgtgtgtgtgtgtgtgtgtgtgtagcagaagcaggtaattaacctctggaaaaaataacattgcaacagatttgatttgcagaggtttcatttctcactgagcctctgttggaatgatgccagttgaaaggaatcccagctcttaatggctccaagtcttctgggagctctcagtgatgttattttctttggagaagaacatcagaatcatttataaaaatcctgtgttcacccatgccatttgctctgtggagaaaggatctatcatatctttaagatgatctctaagatgatataaaagtaaagaaattcatctatctaattttagtttagaaatcattaatgccaatttcagctgctcaggttagtttgtcttgaaggcctgaaagcctccattttgattcaagatgtcgtagattttatgagcattcagtataaccagtaagtttgtcatttccatggttgtagggaatatgagacattctgttatggatctaggattaccgtttcacaggacattctttttttggggggattgttaggtaataaacagtgggacacaaaataaacagatataatctcttcagtttgtagattttcaggtgacaatgaggtggcagaagaggatttgtgcagattaggaaataaataattattgtatataacatgatggaaatattttagtatagtaccactatcaaattaattttgtttccttaactagcttctttcattgtgtacagagacacttatattaaagtagtctttatagatatccagttagctttagttttttctaattacattatattgctagtctcatttcagagtccatgtaggaactacagtagaaaagtagctatcattggcttgtaaataaaattacttaattttgagtttttcttgggaaggaaaaaccagttttacagaattagtggagttgattctggttttggttacttgtgacaatatagtctatttaaaatataaataaataaaaatttgcccaagaagaataagtttgacttgccatgattcatactgtttttctgttgttgtatcacaattgagaacattagtttcagaggtaatagtttgtcagtatgggtcgagtagctctaatccaaaaatccaaaatcagaaatgcttcaaaatctgaaactttttgggtgccatgtgccacaggtggaaaattctacacgtaagtacataatacaaactttgtttcatgcacaaaattatttacagtagtgtataaaattaccgttaggcgggggccaggcatggtggctcaagcctgtaatcccagcactttgggaagtcgaggcaggcggatcacctgaggttgggagtttgagaccagcctgaacaacatggagaaaccccatctctactaaaaatacaaaattagctgggcatggtggcacatgcctgtaattccagctactcgggaggctgaggcaggagaatcgcttgaaccagggaggtggaggttcaagcgagccaagatcatgccactgcactccagcctggaaaacaagagcaaaacaccgtctcaaaaaaaataataataaaaaattaccttcaggctgtgcatatagagtgtacgtgaaacattaatgaattctgtgtttagacttgggtcccattcccaagatatcttactatgtatatgtaaatgttccaaaacacaaaaaaattcaaaatgaaacacttctggccccaagcattttgggtaagggatacccaatgtgtacctttgttaggataatatacttgtaccttggttgtattttagttgcaattgttagttgcacaatttgggggaatgtttgaggtctctatagtagttactgtatttaccaggaagccctgcatgattagaattcttgagacagtgtataaagttaaattgggtgtgttgcctggatgtgaacagtaaaaaaggagaagcttctcaccatacaattatagcttaaaaggaaccaggtacaattctgtttccaaaaatagaaagtaagtcaaatattatatggatatgtaatagtaattatattaattttgactccctggccgactttttttttgaagctatcattttttgtcagagataaaaagtagcttttaaaggaaaagatatctcagcccttaattatgtgtgtgtgtatgtgtgtgtatgtatttatttatatattttagcccttgtaagagaggagcagtggaagggaactgaaggagcatgatatagagaaaagagcctgggttttggtgtgttgcatttgttctgttactagctgggagaccttgggcaaatttacctctctgatcagcagtttaattttttcatctgtaaaaatgggaagaatacctactttgcagaattgtcgtgacgattaaatgagagtgtgtgtgagtacctagcacatcgtaagagagagctcagtaagttatagtagctgttattgtttaaacttcaggaattagctaggttttgctagaactttcatctgtgcttgtaagatctttttgaatccatatgtatttttagcagctgtggctaagatagtttttttcccttgctgtgataatattccttatcttttatatttcaggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagttctgtatttattaacatcagtttgtttatttattcagtaaatattgaatgcctgttctgtgtaggtcattgtcttggcagttattttgagctcttgctacctgctgaattatatcttaaaatgaagaaatttacatgatagagtgatatttattcatctgtgctgaagattaaagtgagaagtatgtggcaggcgcggtggctcacgcttgtaatcccagcactttgggaggccgaggtgggcggatcatgaggtcaggagatcgagaccatcctggctaacacggtgaaaccccatttctactaaaaatacgaaaaattagccgagtatggtggtgggcacctgtagtcccagctgctggggaggctgaggcaggagaatggcttgaacctgggaggcagtgcttgcagtgagctgagatcacgccactgcactccagcctgggtgacagagcaagactccgtctcaaaaaaaaaaaaaaagtgagaagtatgtgtatttgggggaagttgtagaatgaaataataatgattaaattgatcttatttccaaattttaaaaatgtggttactttctatcacatactgtctttttatgttttcctttttattttatttttcagtttagttatatttcagtgaactatttagaccaaaatggaaaagacattggtgtaagttggaatctaagaagttttagatgttcattgcttttgaacagaggaagtaacattttatggattgggcattgttttagtcactacttgaaggagaacctcttactcattatcagtctcttggaaatagcaactgattaagcctatatatactttgtgcatccagtgaaaatgtgataaatatgatgatcttttggtcagagaaggattctggaaactgcagtagtttgattagtaagacagtgtttaaatcatgattacttgttgctctaatattttagactttgaaagatgacaagatgtgatgtaggtgacaaagagcatttttaaaaatgggtgaaattggccgggtgcggtgactcacgcctataatcccagcactttgggaggctgaggcgggcggatcacaaggtcaggaaatcgagaccattctggctaacacggtgaaaccccgtctctactaaaaatacaaaaaaaattacctgggtgtggtagcaggcgcctgtagtcccagctactcgggagactgaggagaatggcatgaacccgggaggcggagcttgcagtgagccgagatcaccctactgcagcctgggcaacagagcaagactccgtctcaaaaaaaaaaaaaaaaaaaaaaaggtgaaatttaggcctatcaagatacttgggatgtaggaaaggaatatatatatatatatatatatatatatatatatatatatatatatattttttttttttttttttttttttttgagacaaagtctcgctctgttgcccaggctggaggctggagtgcagtggcatggtcttggctcacttgaacctccacctccctggttcaagaaattctcctgcctcagcctcctgattagctgggattataggcacccgccaccacgcccgtctaatttttgtatttttagtagagacggggtttcaccatgttggccaggctggtctcgaactcctgacctcagatgatctgcccgcctcggcctcccaaaatactgggattccaggcatgagccactgcgcccggccggatgttacatttattgagtacatattaagtactgctcactgttttaggtacttcctgtgcattgtcttttttaacctttcaactaagctaaatactgttgtccctgttttaaaactgggaaaaatgagcctctgagaggttcactaatacccaagctgacatagtttctaaacagaagacttgggattattactccgatgctcgcttttttgaaactactggtcacagtcgtttgtggttattggctcatctagatcaatcaattggatgaaacccagaaaatagattttgtcttcaacaataccattaaagagttgccttcacattaaaatttaataactacatcttatcctttgtactcttaatcacctgttttccctattttcttttccagatttctgacatgagggattttgtctcatttgctctaaagagtgaacctaaacattgtgtttaggtttgttattagttgctttaaatatatacacatctgtaaacattgaacttttttgatgcctcatctgtgttgcttatagatcattttccatcataattattttaaagtccttttaagaagtttaaggcctatctcatatatgtaatatattaatagtagataatcaggcctttggaagcataaatgatgtaagtaagttgggttgcagttttttcttatcaagaatctgcgtgtgtttaagtggcagtggagataatatttttatttgcgttgttatagtgttatctttatcatttagtttatattttctgccatttaaagataaaaaggttttatcttttatagctatagagtcatcttctgagccttaaaacacttgtgttttttttcttttcgccgtgtgggtggggaaaggggtgtgtggcaatggccctgtgctttgcctctgcctgagttacaggcgtgctttgtttgcctggctggggtttgtgtctcccatgctcaggagggtggaaccagtttcccagggcctgggccctacctattgtcattctccccataaggggatctgttacgtgtacttgtgggaccacacagtgctctgggcagataagcctcttcctgcctatatcagaaccaacatagcccacacacatctgggaaagcatgccagggtcagcaccccaggcgccctgtactcccagcccattccccttcttcttcccactcacctggaatccctgacccaaggctctacctattggttctaatattctggtggacagaatctaagagtccagcaagctcagaatctcaggacctcctcatccctttaggaaccatcaattaatctcatgatttcaggttgaaccactggagtcaatttcagaagttttggtctatctcagaaccttcagatcacactcaaaagcttggggacagcctcagaaccttgggacacatctcagcatacagggtcatcaatcttagaacttgaggtctgtctcagaaccttcatgcgaaactcagaatcttgggaagtcccaggaccttgtgcccggtattataccattggatcaattatcacagtcgcagaatcttgaggtccatcttggaatggtgcagtcagcctgaaccgtgggatcaagttcagggacatgagaacaatctcagaaacttctggccagtcctaggtctgaaaaccttcaaaacagcaacagactcttgcggtccatctcaaaacttgagattgtggtctaaaagggaccctcaagactatccatccagtcccttcctggaatacaagtcacctccacagcctccctgatctcgctgtctagtctttgctatgagccctcctcgatagggatacctggcccctacccactgcctgccttgcttctggatggctccagctactaaatgatgtctccaaaatgtgagaatctgaaatctgtctcctttttcccacatcagccctctgagacctctgcagagatttcaaggcaagacccatatgctcagggtaagctttgtcccagactgcccacactgggttcctcccctgacttccagatctccacccgcccttctgaacactgttatctgcaacacagttacctgtttatgcatttcaattttgagcctataggatatctcatactgcaaaggaaaagcccattgggaatgtctggggtggaggtggatgcccaaccctgtgctgggtgatgctgggggaatcacagcaggatacagagccccagaaccccatggggtcccagaggaggagcccagaggaggaagcgggaccatacctggaggggctgcctctgatctcctcagagactaggggtgcagtgggaggagaagataggagatgcctagagaccctggccccacagagatgcctgtgagaagagggaagattcctgtttcactattctcaagagctgggagaggcttctgagagagaacctgtaatcccagtcggcccaattacagataggaaagataaggctcaaagagggctcagtcctaccccagagtggttgggtgagtcaggactaacaagtcctctttcccattcccctgacatcataactctccccaccatgatgttatgttgctgcatttcagtcttctcactggccatcttctcacattccagcttgacactaactaggaaggagagagaccatgggggtcccacacaccccatatgagccaaagtgaaaaacattgttacttttaatctcatttcttctttgtaaatgattttttgtctctgaaattctgtgacatgaatcagtttagtcactttttatcttattaaatggagagaaaaattgcttaagagatatttaggtgtgttgttttttaaccctttttggttgtaaattgttttctttctttgttttagtaaccccagaaaatctagaagaaaatctagaagagaggtaggcagatcattggtttaaaaaaagaagcccaccaactaaatcttttattgagtaaagtattgtttctaggtagagaaagattagagaattgtattgagaattttactaggtttgggatttacaaagaggctaacatgcaaaaggcagtgctcttcgaaggagtcgtatagatgtggagactttatagcccttagggagatctacagacatccgctatgctgagttctgggaagctgctttttcccatgcttgcagcctccccgtggggtaaaggtctgttagttttgcataaatatttaccatatctcattttagctagcattgcttcctcacactgttagcactaaggagaactttgcttatccagcttgaaaaatttactgtgatcgatatgactaatctggaggatgttctgtcatctttgagcattgatgaagttaaaaagtcagattggcaaaaataatgagggggaaagcaaccggttcacagttgacaaacatttgcccatgcttgttttcccatatttatttttttaaacgagaaggttattacacaagcagcatttcagtcttgtcacacccaataaattattgttgcttttatatgtttatttgtatactagtcgtttacatttgcatttactatacttttacaactgtttccttattttgtaaccatgaacaccagcttctacatgtaaagcctcattctaggtactttatatacatcatatttaatagatataataattgtacaaggcaaatgttattcccattttacagatgagaaaaaaacttagattcaaagacattgattgactagatcagtatttcccagctataaatttttttggaaccaggttttaaattcaagtcttttagcggggcacagtacctgtagtcctagttacttaggaggctgaggtgggaggattgcttgagcccaggagctccaggctgcagtgagctatgattgtgtcagtctacttcagcatgggctacagagtgagactctgtctctttaaaaataaaaaataaaaaaacccagatctttttgactcttgattcattacatttgctactgtacccaattttatgttactccaaatgaaaatattcagccaaagaaggttatttaatctattttaagataaattacaggagtaatttctaagttgtgttacagggaatatccaggacactttaataggagtgtatttttttgactcatgagccctacaacattcaggcattcaaggccaaaggtagaatgtaaaatgatattaaaaggcaaccttcagactttgagtttattattttaaaaaagatccagcttattatggaaaaatggcctaatccattttattagtcaaaaacaatccaacatttgcaatttcatgtgattcaggctaggagcaatctatcagtatgactgcgtcttaaatcttgtcaatatttgataggattctactttaaaatttttgtgtttttgtgtctcttaccttctacttctccttcactccatgtcttttttaaaattttttatgtttttgagaccgagtcttgctctgtctcccaggctggagtgccgtggcatgatcttggctcactgcaatctctgcctcctgggttcaagcgattcttgtggctgagccacccaggtggctaggattacaggtgtgcgccaccacacctggctaatttttttttaagtagagatggggtttcaccatgtttgcccagctagtcttgaactcttggcctcaagtgatctgcctgcctcagcctcccaaaagagctaggattacaggcctgagccactgcgcccagcctccccttatctttttgcatgtacactttgtctttattgtcatcactaagcttttaatctttcctttgttaccccatctaggtcctctgctctccctcaaccttttacttatttctggttgagcccttttgtcattccctgcaattttctgaccatgtagtagatacccagtaggcttcctggattacttggtttttctgtattttgctaaaaagttactccaaagatgataccttctatttggacctttcccaccctttatatacctatctaggaggtagtaacccaaccattaatctctccatgcaaaatacatgtattgactaaaaattatgtgctaggtactgtaatgtttcctacccattattttacttaattctcacaattactctgtgaggtattcacaggtgaagaaagagaaagtttaagtagcatgcctagtgagtggtaaaacttggattttagtatgaatctgtctgacttcccaacctgcactgtttttttttttgttttgttttgttttttttgagacagtcaccctctgttgcccaggctggagtgcagtggcgtgatctcagctcactgcaacctcagcctcctgagtagctgggactgcaggcatgtgccaccgtgcccttctaatttttgtatttttagtagagacggggtttcaccatgttggccgtggctggttttgaattcctgacctcaagtgatccgcctgcctcaacctcccaaagtactgggattacaggtgtgagccaccatgcctggccccagcctgcatgcactcttaaacactatcctatactgccagatatggtcagagttgaatcagatactgtttctgccttttaggaacttcgagtctaatagaggaagatagagaactaagtgcacagggcacagtggagactgaaaggagaaaaatcattactttttggacagatcacagacagcttcatagaggagatgaatatatttgctgaatcctggaatgtgggatgtagttactggacaggtaagggatagaggaacaattcaggtaaaagaaacaatcaggtttttttgagacagagtctcactccatcacccaggctggattgcagtggcatgatcttgcctcattgcaacctccacctcctgggttcaagggattcttgtgcctcggcctcccaaaatactggaattacaagcacgtgccaccgcagctggctaatttctgtatttttagtagagacaaggttttgctgtgttggccaggctgtccttgaactcctgacctcaagtgatccgcccacctcagcctcccaaagtgctgggattacaggcgtaagccaccgtgccaccaaaataaggaatattaataaggacatagaggtgaaatagctcacattttcaggaactgcatatagttcagcatggctagagcatggaggttgatgatggatgggcacagcagttggtaaagttggagtgataggtggtaccagattatggaaggccttttaagtcattctaaggagtttggattttaacctctggattgtagggagccactgaaggccttcagtcagagaggcagtaagcgttatgttataaaagattctttcggtggtagcgtgaagaaaggattagtcttgagcaacagtttcaggggcagagaaaccaatagtgagacatttttcagtaatccatatgaaaaatgatactaataaattcctaaactgaagttgtaacatatacttaaaagcgaagagacaaagttattaagaagatactaagaataccagcagggtgaaaggtgtgtggtcaaagtgtggggctttctgggttgtgtccttgggtaggggttggtaatacttagcaagatagggaatgtaaaagggagaaggcagggttttgttttgttatttttgtttggctgactgataagatggaagatggagaagagaacagacatagtaagggatagatttagtttaagttactaaatctttagtttaagtattcactatctgttgtatgatagattatcccaaaacaataaacttgcactatccactatggtaaccacaagacaaatgtggctatttacatttaaattaattgaaattaaataaaattgaaaattcagttcctcagtgacactagccacatttcaaatattcactagccacatgaagccagtggctacagtactgttggttgatcatagaacgttttaaattattgcaaaaagctcttttggacagtgctgccaaacatttatcaacgcatagtttactaagatcagaaatcggtgagcaactttgctgggtggttctgcttcaaggtttctcatgaggttgcagtccaggtgtctgcaactagaagcaagggcttcaggaatctgaaggctcaactgcacctggtgggtccatttccaaggtgacttactcatgctggtcaagtgagtgctgattgttggtaggaagccctagctcctctgttggtaggtggacttctctgtggggatgtgtgaggcagctggctttgccctgagtgagtgattttagccagagagggaggtagaagccattataacttttgtgagctgacctcaaaagtcacactacatcatttctataatctgttggttacacaggtcagcactattcactgtgggaagaaactatacaagggcatgaataccaagagtcaatggggcccattttgtttttttgagataggatctcactgtgttgctcaggctggggtgcagtggtgtgatcatggctcactgcagcctgaatctcccagcctaaagcagtctctcatctcagcctcccaagtagctgggactacaggcatgccaccatgctcagctaattgtattttatttttatttatttatttatttttggtagagatagggttttgccatgttgcctaggctggcctcaaattcctcggcacaagtgatctgcccaccttggcctcccaaagtgctgggattacaggcataagccaaagtgcccagcctattggtggtcattttggaggcttcccaccacaaatacttacggaatatctgggtacaaatatctagtggacaactaaatgtataggaatgagttcttagctagtgctattatatttgtgatggtagttgaagaaacttgaataggtgtagatcaacaaggatgagattgaaccagaaagacagttaatatagtatcttgggtcacatgtttggggaggacagaagtactttcaaaggctggaggaacagctacaggggagtagtagtagaacaggcaggggagtacattataaaggaaacttgaagggatgaaagttgaaagtagaatgtaattaacattgttcagtagttaaataagagtaaaacttaacagagtcattctttcaaaaaatatttcttgaatacctgtgtggggaaccagagaaagattggtagataaataagaccaagtctctaataacacgtaatactatctgaggagacaagtttgggaaggtttcttggaggaaggtaatattttaaggtagagactctttaaagggtaaggaggtgagttgggtattttaggggtgtggtggtagagatatggatactaaagtggacatttcaggctatgttagatgtggaacactgctaggatatgaagttttgtgatgagggaaagtggtgagaaaagaggctggaaggccaattagagtagtcttgaatacatgcatgttaaggaacttgcctttatcctgctgactgtttcccatacttaaatttggatactactttagtgatttgccataggcttataacccctaaactgtaagttactaaacatttttctttaatattactctttattattttatttatttattttgagacaaggtctcactctgtcactcaggctggagtgcagtgatgcggtcatggctcgctgcagccttgacctcccaggctctagtgatcctcccacctcagcctcccaagtagctgggaccataagtgcataccaccacattggataatttttgtattttttgtagagatgaggtttcaccatgttgccccaggctggtcttgaactcctaggctcaagcgatccgcctacctcggcttcccaaagtgctgggaattcaggcgtgagccaccatgcctggccagtaatattactttttaaacttagaaaccatttccagagggaacttcattgtattgttataaatagaaaaccagtattgtttgctacatataaaagagaatagaaaaaatatgaatgattattacgttaaaaaaattaaaagtggaatgtagcaatgcatcctttgatatagaaaaatgcccacttggaaataagttcctcagtgagaatactatttttggtcagttagcaataaaagggcctttgcttgaatagtgtttggtttctacctaagatgagattttaaggtcattaagacaattccatttttaaattttgatgttaataagcaccaagaatcacaactctcaagtctgcgtacttggaaagatcataatacagttaatggtcaactttgtccaactttattgttaattcaagcactaataaaaattaagcccttttgttccaagaagccatctaaagtagtttatagcaggggtccccaacccctgggccagggctgcacagcaggaggtgagctgccagggcgaaagagcattactgcctgagctccacctcctgtcagattgctggggacgcattagattctcataggagtgcgaaccctgttgtgaactgcacatgtgagggatctaggctgcacactccttaagagaatctaatgcccgatgatctgaggtggaacagtttcatactgaaaccgtacgtacactcaaatccccatctgtggaaaaattgtcttccactaaatccgtccctggtgccaaaaaggttggggtctgctcatctatagaatctattcttctgagtgtgtcaagttatttattggacatctggaaatggagaagggattttttttgtctactctttgctgccatccagtttgggaaaattctcgcaaaaattttcaaaaatttcaagcatcttttacaattttcgaaatatttccagtgagtttttcagaggaatccttaactggtcctttcagagaggaaaaaagtatccagctcacctacatatctcatagttctagtttcacatttatcttgttcactttgttttgtacgtggaatacgtaaacttgtcaggataaatttaggttgttcacataagtagatatatttgtcaagatatgcttatttgcagagcctgtctcaggcatgcacatgatctcacaaactgaagatttcttccagaaatatttgaaatttttcctgcagctcaaaaggatgcatgaagagttttccactctttttgccaaactctatatgtagccccaattttgaagttacttttataaggttttaaataaatggttttgaactgtaatgactaacaaaaggcatgtgaatgatagtgctagagatgctgccaccaaagtaccaagaaagaatatcatgcttgatgataaaataaaagctttggagtgtctcaaattggctgaatacatttaatgagctattagaggaaacatggtaaagatggatggtcatttagaaattctaaagtcctgtaatgttgaggaagctaaacattatcaaatcttggaagaagtaatcaatataggaagaagaaggaggagaagcaatactttggatactaagcaatagtttcaatactaagttgaaattacttagctaacctcaatttaatggactcactacatttcctctgcagaacatgacttttacccagtgagttaaatgcttgtgtctcatggctattttgtagtgtgtctgaatgcttctacttcgtccagttgaattgtataatctcaacccgttgtacttgaattggaattagatgatttagttaaatattatgaaaactgaaaactgatgaaatctgagcaccaaaaagaaagttatttctataaacagtgagttgtgtgtgctttggaaataagagtagagacttgtcactgaaaaaaaattctgtcaaattagacgtgtatacaaaacaattattatttggaaagtatcttctagattattatgaatgtctttcgtttcttgctccactctaaggaaacaggaaataaatcatagctgatatattttaggacagtttataccagaaagctgatgggacactccaatcaacagacccctacttaaagaaacagccaggcgcagtggctcatgcctgtaatcccagcagtttgggaggccgaggcgggcggatcatgaggtcaggagatcgagaccatcctgactaacacagtgaaaccccatctctactaaaaataaaaaaaattagccgggcgtggtggcaggcgcctgtagtcccagctacttgggaggctgaggcaggagaatggcgtgaactcgggaggcagagcttgcagtgagctgagatcgcaccactgcactccagccttggcaacagagcgagactccgtctcaaaaaataaaaaaagaaaaaaggaaaaggctttgatcctacattttaaaattggcaaatgaatgtacatttacataagttgaaataaagtttaaggtttgtatgaatggtttttaattatttcctgctttaactattcttttccattaaatgaccaaccactggtaccagtggattggataagacagttggcactgcgtggataaaggaggtttaaagaaaaggaaacatgaaatgccttctttttgaggctgctacaataaccaagttacaagtgtgctgattaatttattattcctgtttccagaaatgtcttatttgtatttcatttttaatatttttaaatttaatagtttacatttcccccactagtgttgccttctatttgtagcaagttaatactggttttctatttataatagtgagataaagtttcctttggaaaggaatgttacctttaaagaaaaacattaggtgactaataatttggtgcttatgtgactgtggcaaatcatgaagatagtattttaagtatggaaaacaattgctaaccagcaagataatgtcaagttccttaatatgaactcacttcttggcctttgtctaccttctccagcttcatgtcttaccactttcccttattatggacttcatgttgatcaagtggaggctccctctcctcaaggagagtccctaggccagattcagaagatggttggtagagaggggatttgatagcttctgaggacagtgctttggatggagaaatatcatgcaacttaggacagtgctttggatggaggaatatcatggaactttagttttccagctttattgagctttgcctgtgatattcacttgtttggggggctgtttggagacagggtctcactacattgtccagacacaatcaccatgtactgcagccttgaagtcctgggcttaagtgatcctcccatttcagcctcccaactagctggaactacaggctcgagccactgtgcctgactcttactcacttttttgttcccaatacctggaagaagatcgtcagtctgtaaatatttgaaatctaaataagggttatggtgctgtagtataaggccaaatcttgggcaccaaacaaaaaaaaatttagaaaaatcccttagcccatcccatgctgtgctgggagcttcatctttctttttaattgcaatttaaacgatctactgctacaagagggttgtggtaaagcagaatttcttatactgtgcaggtgggcatgtaaattggtttaaacttacagaaaataatttgacaatatagttcaaaagcctaagaaatgtttaaactttttgaattagtaatgccaattttggtatatatctcaagacattaaggatatacagttttagctgtcattttatacaaagagatcacccacaccattattttagtaggggcaaagaggaaccaatgtaagtctggtgcctctgaagaggtagacctagaaactgggatgacaaggaactcccaggggactgctgttaataaattactttatgtcatttgataaaatatatgtaagcattaaagacattttcaagtaaaccttagtgaggaaattgttcatgatctgtgaaaagtatgggataaaacttcaaatataatgccagttacatttttaaaaaacattcatgtgatgcttttaaaaagacttctaggacatgtaccaattttttttttttttttttttgagccaagtcccactttgtcgcctaggcttgagtgcagtgggcacaatcacagctcactgtagcctcagcctctcaagtagctgatactacaggcacacaccaccatgctcagctaattttttaattttgtgtagagacaagctctcactatgttgcccaggctggtctcgaacttctggactcaagtgattctcccacattggcctcccgaaatggtgggattataggcacgagccactgaacctggcatgtactactttttaagtgtttctgggttgtgagattatagatgaattttgttttattcttcacactcatatgttgttttctaggcttttaactatgtgtatatatatatattgcctttgtcatgagagacacttttgtttttaagtgaaacctctgtttagtttttatttatttatttgatctttattttaatggaaaggtaactgtgctggtaagctgatagatgattggaaggaataattcttgagactaggaatgcaaatgaaagactgctgggagatatgagaagctcctgaactagggcagtggtgataggattggagaggaatatcgtgatcagtaagacataggaataaaggaaaaagagggatccaggatgactcccaagtttctgggtgtttaaatgtaatacatttgagatgaaagtttggctcttaaaaaatattcttatttggggaatgtttaaatttagtgaggtcattaacaacttcagattccttttatacttcaattctttaaattctatatgttgccaaagatcctacttctaatttgttagggttaacaagaagaaagatgatatgtctgtgaagacatgtttctgacatctgtcaccctatggattgccagttgatagacctggttgtcttgataagtattagctgactccccaaccagtttatttgcaccacttctgaagcaataagcttggttgaaaaagggcacctcccaagtagggaaggataatttttaggtcaaattatagaaattgcatgtatccctgttaacacttccaacaccaacaaaaaaatagacaggaaaatgaccctaccagctaattctccattataagactttgaagaaaaggttccattaaaaacagaaaagaggctgggcatggtggctcatacctgtaatcttaacactttggaaggccaaggtgggagaattgcctgagttcaggagtttgacaccagcctgggcaacataacaagaccctgtctctacagtaagtaaaaaattactggatgtggtggcatatgcctgtggggccagctgtttgggaggctgaggtggaaggattgcttgagcccaggagtatcaggctgcagtaagccatgattgtgctattgcactccagcttggtgacagagtgagaccctgtctcaaaaaaataaaaccttgaggacccaaatttgatttaaatttagatgtactatctgctttgggagagttactttattattatttagtagagacagggtctcactatgttgcccaggctggtctccaacttctggccccaagcagtcctcccaccttgggctcccaaagtgctggggttacaggcgtgagccaccaaccctgcccttaagttatttttttgatcttttcatgacatgctgtgggcaataaaataatacagtgggtgatctgttgttgcaattcaaatatggagttcctttttcttccacaaaagtattggctgatttctttctttttctggctgtgagcaacaggtaaattaacatgaccatggtctgtccccagcgtcttgactcagatttcttaatttgaacttttccatcttctccactccaagatcacatgacaacatccaacatcagtggatagaaataattagaggctggatgaggtggctcacgcctgtaatctcagcactttgagaggccgaggtgggcggatcatttgaggtctggagttcaagaccagcctggctaacatggcgaaaccccatctctaccaaaaatataaaaaattagctgggcgtggtggcacacgcctgcaatcccagctacttgggaggctgaggcaggagaattgcttgaacctgagaggcggaggttgcagtgagccgagattgtgtcactgcactccagcctgggtgacagagtgagactccatctaaaaaaaaaaaagaaatttaataagtcactgctacactggcaaagaagggttgagtagttttaagaagcttagttgctgtccaacagtcttattgcatctgattcttttggtgcttgcttactcaagtagggatcacatagcatgggaaggaaagagcagatctgtgattctgttgtttacatctcagaattgtggtttgtgaatagttttgaaatttttcttatagttttgggagaaatttgttaacggaatttttaaggattataggacagcacaaaataatttctcttgtttagatgcttttaataataaaaaaaatctgttaggatactttttccttttttttttttttttttttttttttttttgaggtggagtctcgctctgtcgcccaggctggagtacagtggtgtgatcttggctcactgcaacctccgcctcctgggttcaagcgattctcctgccttagccttctgagtagctgggattacaggcgcatgccaccatgtccggctaatttttgtatttttagtagagatggggtttcaccatgttggtcaggctggtctcaaactcctgacctcatgatctgcccaccttggcctcccaaagtgctgggattacaggcgtgagccaccacgcccagcctagaatactgtttaaatgataaaatagctgagtgcagtggttcatgcctgtaatcccaacactttgggaggctgaggcaggaggattgcttaaggtcaggtgtttgagactagccctggcaacgtagtgagaccctgtctctacaaagtaatttcaaaattggctgagagtggtggcacacacctgtagttccagctgtttgagaggctgagttgggaggattgcttgagcctgggaggttgaggaggttgaagctgcagtgagctgtgatcgtgccactgcaccccagcctgggtgacagagcaagacctcgtctcaaaaataaataaataaaagataaaataagaccgaaagatttcattatgggatagagaagaaaactaatatggaatttaagataatattcttatatttgagtggcctctttttttgagacagggtctcactcttattgctttggctgggccacagcggcatgatcttggctcactgcagcctggacctcctgggctcaagcaatcctcccgcctcattgtccatactgtctagctatctccatgataacaacatcatcttatatcatgactactgactaaaatccttagtagctgggactacaggcacatgctacaatgtctggctaattttttaattcgtttatagagatgggggtctccctatgttgccgaggctggtctcaaactccaggcctcaagagatcctcccaccttggcctcccaaagtgctgggattacagacgtgagccaccatgcctgacctgagtagcctttttatttaaagggaatcggcatttgtttattacctggtatgttctgagtatcaggctgtgtacttaacctcacttaatcctgacagcattcctataaagcagatacctaacaattatttgtgaggaaattaaggttcagtgactttccataaatttgcttatggtcacacaatccattgagtgcttgtgccaggttttaatctcagtctgaccaataccaaaactcattttttctatgtatgtttcccttttagaaagattttatttttttaattttaattttaattttttaacttttaggttcggggtacatgtgcaggtttgttatatcagtaaactcttgtcatgggggtttgttgtacagattattttgtcacccagttactaagcctagtacccaaaagttattttttctgccccctccctcctttcaccctccaccctcaaataggccccagtgtctattgttccctagaaagatttcataagtaaatgtcatctagcctgtaaattatttttgtttgccagcatttataatataggtggtcattctttaggtgctgaaacagaattggttttgtccttagtgtctggctgtctccaatgataacaacatcgtcttttatcatgactgctgactaaagtactatattctcaaatcttcttttcttctttttttttttttttttttctgtgacagggtcttactctgtcccccagtctggagtgcagtggcatgatctcagctcactgtagcctctgcctccagggttcaagtaattctcccacctcagcctcccgagtagctgggactacaggcgcacacccgcacaactggctaatttttatatgtttagtagagacggggtttcaccatgttggccaggctggtcttgaactcctgacctcaagtaatctgcctgccttggcctcccaaagtgctgggattacaggcatgagccatcccactcggccagatcttttgtttttaattgaaaacttataatacatttcagagataaaggagagctatttcagaactggtgcttattggtaagttttaaagagttaaagtcagtgaactggtggtataagccatttaatcattatgtttatcattttatagatactaatcggagtaatgcagtttcaacaaaagtagtttattttggggtatacaagaatttttattctttaagctaattaattctaaatttaaaagaaggaaaacacctgagaagcttgcgctcttagtgttactacacagaagtctcaatgtagctgcaacatctgattttaaaattttcttttttcgtcttatacttggaatatttcacaataaagtaaaaagaaaatgatatacatccatgtacctgctacttagtgttatctttttgggggacgaggcaagcaaataaaaattagagatgaagtcgaggctcccctgggtattttcccccgatcctgttctcttctgcccctttccagaagtaaacatcatagtaaacttggtgtttgttgctcctatgcatgtttttatactttggctatatgttatgtatcttcaaacattatggaaatttttgcagatttttaaacttcctaacatttgaattcatgttctatattcagcaatgtgtttattaacaaaatatcaataaaaattactaattataactgttactattaataatgaatattaataaaatattatgaatatgatatgaggtagggattgagttttattctttcatgtggagaatcagtcgtctagccccattcactgtgcagtctgtcttttccctactgatgggtagcactatccttgtcatacataatgtttccattatttgtaggtttgtttctgagctttctaatcttttcccttggtttgactatttctgtaccgacaccaaactgttcagattactttagcttcataagcaaagtaaatctccttaccttgtttttcttcttcaaaattttcatcgctattcttagctttttctttttccatatgaattttgggatcagcttgtcaggttcccttaaaagttttatttttttttaacattgtaattgcattgaatatttagtttagtttggagaaaataggcatatttatgatattgtcttcctatacatgaacgtggtttttccttagaaattccagatattcccttatggtcttcaatagtaatttataattgtatccaaaagtcttaaaacttttttggctaagcttatttctaggtactttatgattttctctgcttttagaatggttggtcagtctctttctttccctctcctcctccctcacttattcttttccttcctgtttcttccttcccatcccccattccaacctcctttcattttttttttctctctccttccctcccttatcaccttttaattttatattgttttggctgacagttctatttaaggtagtgtgttatagagaaaagtatatggaacttagagtcaaaattgctggaaatgagtccccgcttcgtccttcaagaattatatgataattaagtcaacttttctgagcctaattctcttaatctgtaaaaggagaatatttacttttatactgtctacctcacagaatcaagtgagatatgtgcatgaggttttttcctaattaaaaattcagtgctaaaaagagttctttctaggggaaaaaaatgccaatttcccccaactaaaagtatagacatttattaaaactgtatctttagggctgggtgcggtggctcatgcctgtaatcccagcaatatgggaggccgaggcgggcggatcacctgaggttgggagtttgagaccagcctgaccaacatggagaaaccctgtctctcctaaaaatacagaattagctgggtgtgctggcgcatgcctgtaatcccagctactcgggaggctgaggcaggagaattgcttgagcccgggaggtggaggttgctgtgagctgagatcgtgccactgcactccagcctggtaacaagagcgaacctccgtctcaaaaaacaaaaaactgtctttaaagaagaataccttaatacataaacttattattttgactcttaaagattataacccttataccccacttcctaaaaaaggatgtgaaatggtttaaagggcacgtaaacatacactcacctcagttaaagatgttaaaaatagaaaatcaagttattacagtgagatcagtgcaaatatgataattatgagggctaatacagccattgtaattaagcctctctgctttcaggattctgtgggaataaggtaaatatgatttggttctattgttggatgtatttcctcctttgagacaaacctaattttactcccattaaattaaaaaaatactgtccaccaaggtttcaagacaatattgggaacaatatctgctacaacagtttcataagtgaaagagcactttttcaaatggttttttgaatgaccgttactaaaaatctgaggggaaaacagaaagcagcactcaccaaaactgatttctttggaaaaactaaaccaaggttatttagatagcttatgatctaatttgtcaggcactgagctggtttataacctagagcagtgatgctttcaacatttttgtgttaacacatatgaacttttgaatactaaaatttttggtaatatgttgaaacttccaagggaacattagataaagtaatagtaactataaggtaaccactagtacagtaaaaatgccttctagttacaaatgaatccaaagcaatctctattttacttaacactattaagcactgcagtctgagtttgattagaactgtttactctctgatctcctctgatcttttttttttaattcaggaaccaaaatatttatatgttctaatatagatataccatctttaacattggcttgaaattatgtaatgcctctggattgtagttatttgtgcttcactataccctgtcatatactggcccagtacaaagttctttctgacaagcctttctaccagtgtgttattaactagtttgctttgtataatgcagttctgctctcaaatacatctaggcaagtaaccaaaggaatcctaggttaactttctgcatttgaaagatgtatttatggaagactgaagcttattttttatatggtaaggcaggtgctcagtttttatggggctttttttccctataatttttcaactttttgtaaaaagcagacaggatttatgataagataggcctgagttcagatccaggctctaccatttgttagctgaacaaccttggaaaagttatatagcttctctaccttagcttttgtctctttatccccaatatctcttatcatgtctacttcataggacttcagatgtgaagtttttaaaaattatcaaactgtaacttattgataattttctgcttaaggtcactctaactgaggaacctacccctagaattaaaaataaatgcacaaaataagctattaataataaatgttgaaaaaagctattccgtattaccagtataatctaaactgaaacaagattttttcttagaagtaattttttctaagtataacaatgctttaaaataaccattatataaaatttctgacatagataaaaattagaatagcttaatgaaccttcactgacctgttaccagctttagtaataaaatacagtttagattaatccttttcaaccatataagatataaagtgacaaggcccctcccctctcccagttgtttaatatgatttacctgaggtagccaccattaacttcctttacacaaatgaaatcaccccataggtgctgttttgtagcttgacattttcatttaacaatatactttttaaaatatgttttatttccatgtgagtacctatgttctgtggctatacaacattctgttctctacaatgttctatataatattatggcagcaaaacacaaaagagtgaaatgagggatgtttgttttatccactgctgtgttcccaacacctagaacagtgcctgcacataatagatgctcaatacatatttggtgaatgaattaacatctagttaggaaatgtatttctaacttggaaatgtatttctattattggtacgatattctattatataattgtataatgatttatttaactagtagaataatgatggatggtaggactttgggtttttttcacctttctatgtttttttcccccttctatgtttttttcccccatattctcttcagggagcaactattatcttgataatggtggcaatttaagaaactactttgagaaaataattaaaatatgaaaaatggattttttgtttttgtttttgagacggagtttcgctcttgttgcctgggctggagtgcaatggcgcgatctcggctcaccacaacctctgcctccaggtttcaagtgattcccctgcctcagcttcctgagtagctgggattacaggcatgcaccaccacgcccggctaattttgtatttttagtagagacaaggtttctccgtgttagtcaggttgggctcgaactcccgacctcaggtgatccgcccgccttggcctgccaaagtgctgggattacaggcgtgagccaccgcacccggccaaaaaatgtatttttatggacacccatagctaaatgtctttccatctagtggctggttaaccaagcatggttcctcctgtttcctttccctatgatcatttcagagtataaccattgtttagtgtaggagagatgttatgacttttagatatgctttttttcataaaaaggaattgcctagttagaattttttaaagatatctcacagttcagcagttttgacattgctggggaaattttatccagggatacagaagaaacgttcattcatttttatttaagcacctataaaaagtaggggggtacttctggcaatacagttgggttactgtttgtggctaaatatgtgtgtgaacattacgacatttgatgaaaacagcttcattgagctactgagctctccagctgatttttcttcttggccttaaaggtttacaaggctaagaatcaatctcctctggggtagatggccttacggattttaaatatgtgttgtgataaaagtgattttactctaatacagcatagtacaagttaacttccagtatgcagaattgacctcgtgaattttagtttaatgatctcagttctcatgaacttgcaaacatagaaaaaaaataaatatttttaaaaaacttttctttttaaattgtgaaaaacgtatatgatggttacagcaaagattatgcttttatgactaattcattacattgagtcatacatattaatgattcaaattactaacatagctctattaaattaaatctaccatacagtatacaggtattctgtactttgaaatttcataaatttttggatatcaactctcagaagggtatactagtaatttgcttttacccacaaaatcttcagatttgtcaacaaaatgaacgagattggtattttcactttagtttctcagtgaaaataaagaatgggtagatgaatggtccaaagagctaagagagaagacttaatttaaactcaaataaacatgcccagaatgaccctctctttttctgcccttcctcctgccacagttagccactgtatgtctcaggttttaggcaaagtgagtcttcttatcatggaaactgtgaacattcattaacaactggttttactttgaaacttaaacagcaaacaccaaagagtgaattgttggtataatccatgggagtcttgagattgacgtcagaacaccagtacagctgtataagcattgggaagtatttttaacatccgtgttagatcatctttttgacctttccttttatgttttctctttttccattaaatggttaaaaaaaagagctttacaatattttctaccaacactgtaatgatattcttaaaaaaagcacccgtacaattattttctttgttcctttcccctttgcaactttcctttacctgtagtgttccaagttctgatggggtggcctttttttttttttttaaataaaaagtttgtttttgagaacagggctagatttgccgaaaatgagaagctagaaaataacatataccccataggcatgctcagagtcccctattattaacatattacatttgtgtggtacatttgttactgaaccagtgttaacattaatattaattaaagtctgtagtttattcagatttccttagtttttacctattgttctttttctttcctcagaaaccacattatatttagtttgtcatgttccttagcctcctcttggctgtgacagtttctcagatttttcttgttcttgatggttttgacagttcaaatgagtactggtcaggtttcttgtaggatgcccctatattagaatttgcttgatgtttttcttacgatttgactggagtatgggttgttggaaggaagatcacagaggtaaagtgacatcttcatcaactcatgccaagggtacttaccgctaacatgatatgtgactattgatgatgaccttgatcaccaaaataatgtttatcagatttctccagtgtaaagtattggaatgttctggtaggcatatcctagttaggttaattgctctggtaattgcttgggctttagttattaaataaatcatcatattggtatactgctcattgaaatgttaaatttttttttttacaaataatgtgttcagagttgagaattagattttttaaatgttcagattgtattttcaaattgtatttttgaaataaagctttcctttcctgtcgaattctaaagattttgtttatctaagggaacaacttaggttcgtattttaagtaggaagttagagagcctggtcagtttatctgcaatttaaattctagacactgagacttatttccttcattttatcttttaaaaaatagactgagatataatttacatataaaattcaccattatattattgttaatttttatgggcataagtatttatatttatggattacatgcaatattttgagacagggatacaatgcatgataatcacactaaggtaaatggggtatctattacctcaagcatttattctttctttatgttacaaacattccaattatactcttctagttatttttaaatgtacaataaattatggttgactgtaatcactctgttatatcaaatactagatcttattctatcgaactatatttttgtatcctttaacaatcccaacttccccaaccccccactacccttcccagcctctggtaaacatctttctatctccgtgagttcagatgttttaatttttagctcccacaaatgaatgagagcatgtgaagtttgtctttcggtgtctggcctatttcacttaacataatgaccttcagttctatttatattgtggcaagtgacgggatctcattgttttatatagctgaataatactccattgtgtatatgtaccgcattttctttatccatttgtctgttgatagacacttaggttgtttccaaatcttggctattgtgaatagtgcatcaataaagataggagtgcaggcctctttgatatactgacttccttaagttcactcattttaagtgtgtacttcgatgagctttgacaagtgtgtatactttttaaccaccacaaccagcatagttaagatatataacatttccatcaccccaaaaaattgtctctgctttctgtcacaatagttttgccttttctacttcatgtaaatgaaatcatgtacagtatgtaatctttctgtgtctgtcttctctgtctctttttttttttaaagacagtctctgtttcccaggctggctggagtacagtggcgcaaacacagttcacttcaggcttaatatcctgggctcaagtgatcctcccacctcatgctcccaagtagctgagaccacacaggtgcacagcaccacacctagctaattttttagtattttgtagagatggggtctttctgtgttgcccaggctggcctcaaactcctgggctcaagtgccctgacccctgcgaagtgctgggattacaggcatgagccactatgcccagcctttcttctctttttttaggcttaatacttttcagatgcatccaaattgtttcatataatggtagtttgttcctttttcttaccataatagtattacattgtgtgaataagtcagtttctttatccattgacctgttggtggaggtttggattgtttccagtttttggctattttgaataaatctgaacattttcctgtaagtttttgtgtggcatatatttttctttctctttggtaaacatctcagagtagaattgctgagtcatatggtaaatatatattaacttttaaaaaattcttttatttatttttttagagatggggtctcactatgttgtccaggctggtcttggatcagccttggttagggatcctcccacctcaccctcccaaagtgctgggattacaggcatgagccaccacacctggccttgattaactttataagaaactgccaaattgttttccaaagtgcctctgtcattttacattcccactagaaatgtcgaagagttttacttgttctacatcctcatcaacacttggtagtatcagtctttttaattttagtcattgtagtgggtgtgaatggcatctcactctactttttatttgcatttctctaatgatgaatgatattgaggacttttcatttgcttattgaccttttgttctcttttgtgaagtgtctgttcaagtcttttaagaagttggcttgtctttgtcttattgagaggtaaggtatgggtcctttgtcagttacatttagaaaatgtttttctttctgtttgtggcttgtccttttatttccttaacaatgtctttcaaagagcataagttattaattttgatgaagttcagtctatcaactttttattttgtattcatgcttcttggtccctatcgtaaatatcttgacttaacccaaggttgcagaaaatgtcctcttaattttttctagaagttgtatagtttagctcttatgtttaggcctatgattcatatcaagttaacatttgtatatggtgtgaggtaaggattaaagtttgtgcgtgttttggcatgttttccagcaccatttgcagaaaagactgtccttttcccgttgaactgctttggcatctgtgttaaaaacttaatagactgtctgtgcatagttgtatttatggtttctttattatgttctgttgatcaatatgcctgaacatattgattgatttattaccttagctttaagtctttaaataaggtaatataagtcttccaattttgttgttttcctaaaaattgttttggctcttctagatctttgcatttccatatgaatgttagagtcagcatgtcaatttctatttacagaaaacaggctgagattttgtggttgtgttgaatctggatcagaatgtggagaattgacatcttaaattaggtctcccaatccattggcataatctttctctccattaatttagtagtcttctttaatttctctataaacattacatagttttcagcatacagggtttgcacatggtttgttaagtttatgtgttttgaggttataaatagcatttaaaattaatttttaattctttattaataatatatagaaatacaattgatttttctatgttcatcttacatactgttactaaacttgctttttggtgctttttttatatagatctctggagttttccataatgtcatgttattaaaaagttttactttcatttaaaagatgtaagccttttatatatttattttcactgtcttactcatttggctgaaatgttaaaagaagtggtgaaagcagacatgtagacatcttttcattgttctcaatcttatggaaagcattcagtattttaccattaagtacgattttttttttttccatactctatcagtttggggaagttaccttctattcctagcttgtaagaaattttataattaacagatattgaatttagtcatatgctgtttctgtatctgtttagatgatcatatggcttttctgttttctttcttttttttgacttgccaggaggtattttcatctgaggcttttctttcttagactggtgatacagtgaattacattgatttttgagtgttaaacctacctggcattcttaggataaaccccatttggtttatcctaatggtctctttattatgtattatgtattattctttttatttattgatagatttggtttactaatattttgatgattgttcttgttcctttgttcctaagggatatttgtgtttagttttcttgtaatgtcattgccttgttttgatactgagacagtgttggcctcagaaaattttttgggaagtgtcatgtgttttcactttcatttgtcagatgtagaattgttatctcttcctttaaatgcttgtgataattcaccagtgaagtgagttttctttgtggaaatgttttcaaccagcaattaaattcactgccccctgagagtacccactattctgacttctagtaccatagactaatccttaaactttttttggattaattttttatttagagaaaagttgcataaataacacagaaaattcacgtagagttcccatataccctacacctagttttcctgattgctgacatcttacattattgtggtatatctgtgaaaactaagaaaccaaccttagtacatactgttaactaaacttcatacttcatttggatttttccagctttttcattaatggcctctttctgttctaggatcaaatttaggataccacattgcctgtagttttcatgtttccccagtctcttggtttgtgacagtttctcagtttttccttgtttgtcacgaccttgccatccccgaggactttgtagaatgccccccagtctgcgtttgctgctgttgctcggtattagactgggttatgcgtttttggaaagaatcctcttttcctctcatcaggggtgcatgatgtccacgtggcatcactggtgatgttaaccatgaccacttggttaagatagtgtttgctaggtttcttcactatactctgttttttgggaacacattactaagtccaacccacactttaggaagggggagatatctacatacatggtttgaaattcttctgtaaggaagatttggatctttccccacatttatctgtttattcagtcatttatatcagtatggactcatgtatgtttattttatactttgagttctaatgctaggtttcttttcttttgcttaaattgttccaactttggctattgggaaggttttccggttactgtttatgtccctttcatatgcccctatccttttgttttttgaacatctcctgacgtggtactagaagatgctccaggctcatcttgtattttctttgcatcagctgtagaatcagccatttgaaggaactagcattccttttatttaggaaccaaaatgtagttactaggtgtgctcattgctattggagtatcgttgcttttaggccctctcaggggacagagctaggtaatatctgtgtgaatactaacccatgtatacacatacatctctaattgtttctatatgtatcagttggcatatatgttaagttaaacatgagttgatattgatgtctctgattataatccattaccacaaggttcactctagtcctcctttttaatctgtgacttccttgtctgaccataagaaacctggctccagccaccccattatccatccacttattttttcaacctatgtacacatgaaaagcaaatttagaattattaccccataccccatgagtacagtatttatgtacagtttcttttgtcattagccttacaatttcaagtcaaaacaccgtgttccaaagtttgttaggtaagctcctttttcaccgccccttcagtgaagttatgtcatacatttgtaatgcagttagtttcatttgtcgcaatccacatttcatcttgggatcctctgacgttttggttgatgttagtggttgttgtttggttaacatttgttgaagttcactctttgtactgtgccattctgtgggttcagacaaatgcaacgggtcatgtattcaccaccctaatgtacagcgcagatcctgcaccctaaatgtccccctgtgcatcccgtttgtagtcaaacactctcctctcctctagtccctagcaactactaatttattttctgtgtctctacttttgcattttccagagtgttgtataaatggaatgatacagtctttggatttttccatgtagtaaaatacatgaaaaatccaaagattgtatcgggcttctttcatgtagtaaaatgtatttaagattcatccatgttgtgtaaattaatagttcatttgttttaaaaattgttgtactattccattgtgtggatgaatcataatttgttttttcattcccccattaaaggccattgtagttactttcagtttttggcattaggagtaaagctgctgtaaatgtccatggccaggtttttgcatggatataagttttcaagtcccttgtgtaaatacctaagagtatgattgtaggtcgtatggtaactctgtgtttaactttcgactgcttttgttctttatagaaatggagttgtgcagtatgtgctcctttttaatctagcatctttcttttgaattgtttatgacatttatctgtatattttgagtggtcataattcatttgcattattgattaatattctaatgtgtgaataaactacagttttaaaaatccattctactgcagatggacatttagatagctctagtttgggactgttactaacagtgctgtttaggaaccttcacagacatgtatttttgtgaacatacatatacatttctgcctagttgtggaattcgctggtacagctttagctgattgtaccaagtaattttctggagtgattgtaccaatttatagtctgatcagcggatgtagtttctaggtgcttaatgtcttcatgagtactgtatgtattcattcattctatttctctctctctctcattgtggttttaatttacatttccttaaagttgagcacctttttatatgtgcattggttatttggatattcagaaaaattaagaaaattgtaaatttcttctgggctctgaaagcattggggtttggaataaggggtggcttccattaggaaaggcagtaagggggccgggcgaggcggttcacgcctgtaatcccagcactttgggggccgaggtgggcagatcacgaggtcaggagattgagaccatcctggctaacatggtgaaaccccatttctactaaaaatacaaaaaattagccaggcgtggtggcgggcgcctgtggtcccagctgcttgggaggctgaggcaggggaatggcgcgaacccaggaggcggagcttgcagtgagcggagatcgcaccactgcactccagcctgggcgacagagccagactccgtctcaaaaaaaaaagagaaacagtgtctttgggggagagccaggtgttggtgaaggcagcgtttggagtgcattctgtgaagaagttaagagtgtagtggtgtttggtttcttgtagcaagagtcctagagcagtggtccccaacttttttggcaccagggaccggttttgttgtagacagtttttcaatgggactgggagggtgttcgggggagggcagtagtgggatggtttcagggtgattcaagcacattacatttattgtctaccttattttcattattattacattgtaatgtataatgaaataattatatactcaccataatgtagaatcagtgggaaccctgagtttgttttcttgcaacttgacggtcccatctgtgggtgatgggaaacaatgacagatcatcaagcattagattttcataaggagtgtgcaacctagatccctctcatgtgcagttcgctatagggttcctgctcctctgagcatctaatgctgccactgatctgacagaagtggggctcaggtggtaatgcgagtgatggggagcagctgtaaatacagctgaagcttcacttgctcacctcctgctgtgtggcctggttcctaacagatcatggaccagtattgtctgtggcccaggagttggagacccctgtcctagagtacacagtgaaaaagtttgatagagaggggaacagtggaagattttgttagatatgtcacatgattaatggatgactaaagttttgtttggtgatctaggatgatagagatgttgagacatgaaattagttggcttcaagttctaagctgtcctgtgtgagaaattgcctcatcagccaacacaggctttgacatatgggtagcttcgtgtttcttaggatacttgggctggtcagaaagtgccaagcatcagagaaactgagacctcggtataggtggaggaagtctaatgatagccacagtcagtagcctagtctgatttgtttttagcaaatctagactattttcttaatcagtaactacttctttagtaactacttacaaggcgactgcctttgccaaggtatatgttctctgaaagctgattcttcatagatcactaactgtagttttgaggttctgtgatttccttcaaaattcacagaaccttgagctataatttatgtggatagagtgattactgggatttaacttaaaattagatgtattcaaatgttttaaggaatatgttttgtaaaacaacatgtttttcattcgttacttatatattgatcccagaaattgtgtgcctgcaaattgtcaagttgggttgatgcttcagaaaaggaaagtagaggctgagtcttcttagtatagcaatgcattttttagagcagtgtttgaggcaaattattttcgcaaaattacatggcttctagggattagattgcatgagtttgtctcttgttcctccctcattctactgtaagaggccaggctgctagttaacagaatgccagacataatgcctagggcatagtttgagacctgggaagattcacaataatcaaacacaaacagacagagtagcatgaagaaatttcaatcctcccagtcttgcttacagatttaattaggcttattggggcagaaaatatttttcctccccccatgtttaaatctgtttctcctctactcccacctcctgtcccagattctctttgaaggggtaatactagcaacaaaaggagatttttttttttttttttgtaaatcctaacttatttggtttatctggctttaggaaaaggagcagtaacaacaaccgaattttaaggtatttgagggactccattttttggcactgtatttgggaaattcccaatttaaaaatcatgctgtactcaagaagaaaattagggtttttttgtggctttataattggatcttttttgcaagtatttttaattttatgagaggtatttggcctgttctgctagagaattatcagccaaatccttgctttctttatattatatatattttcctgagtgatattctagggaaatgtatatggatgctgttctctgtctttccattagcagcgcagtgttgggcttcgaatgatgatggtagatgattgggggtgggagaagaggtggggtttcttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtaatctactgcagtctttgttttctgggtcgtgtataaaatggagcaaaatggtagaaaaatagcttcagtgaaagggatgtacctgttaacaggaataaaatagaaaggaaaaggatatttttacattgttcattattatttctcacaacagcttttaggatttttatcatgttttaaaaaacctaatttgacctaaggaagaaaattcctagttttgaaaacccgtgccttaattgcttagctttagaacaaaggtttttacatccagcattgcaaggatatctttattcaaaagaataggatgcagcattcttatgttacctttttagaactgaattggcataacctctcttgaatcttagagactttgacgtattattctgtgaattgtgatttaattatctcatgcttcaggatggttgtttccctttgatacccaagagaccatggatgggatatagggggtggggattaatattacagtgggggaagggagtgtttttacagagtaaccttcctgtttttgcattggaaactaaattgaaatatataatcattggaaaaggtggtatccatggcaccaatcttatcaacttgaattattttatcctttgttcagtttgtggtatttttgctcttgtcagctgaaatgttgattataaatttgaagaagctgccgagttgctgtgatggcactggaattgcattctgctttctttttctttccaattatagctgtaaatacaggaaccaagggatgaatgtgaaaagaagtaatataaaatgctgaagatatttttggttttctcttgaaagtatttttcatagtgagaattattttcttgtggacagaaagagctaggaccctaatttatgacattaaaaagcatttaagtgctacagacttctctatttaggaaagacagactgaaaacatgttgaagcgtactatggagctttcagttaagttgattatttccatcatggtgatatgagttatcatactgtttgccacattttgaaagctgtttgactcctcagaagtattaacaaattaacaaattcttactgagcatttacattatgctaggttctttagatgtatatcaggtttatagtctagtaaaggatataaaaaactcatgcatatgatgtaccatttttggtgcaagcatataagtattgcagtgttatatatttatgtactgacatgtaggtgttttacataagctactacatttaatcctcataacaacctagtcacgaaattattgtcattcttgttatcctatgcacattagtccaaacaagcaaacaaaaattgtcattctcttttatagatgagaaaatttacattttgagagattaagtgatttaccataagtaacaaagccatgaagtgatgaagcctgggtcagtcagactctaaagctctttccactgtttgtatatgagtagattaaagcattttatcatgattatttgacatcacaaatagtgatgccatgagtgaaaaggagatagggatcctaatctttaatctatgccaagaactgagtgattgagcaaatcatttaacatcgtctgtaaagtgtgagggttggactaggcaaccttggttcatgattctattcagtgtaagagattttcacatatggtctatggaaacaattctcattactttagtgtttttattatatttagtttccattactcatccttcataatgtgctgtacatgttggattgtgtgtggtggggggggagggtgatagagtgcatatcatcttctaacatattacatacaatatacatttatttattaagattattactgtctgtcatcttccttcttcccttcccccaaatatgtcacgaggacctagactagagcctggctacatagtatgcagttataaactaattttttgaatgaatgaataggaataatagacttgtatagtacattggcaaaatatataagtaacttcataattcttaacaccaaaagattccctgggggccaaaattattaatctttctattacagtgatcctttaaggaactaagtgtaagaatcttaaaaagaagaacacctacgaaacaatcaagtgtagtcaagtaatctgaagtttgctggaattcccccatacaaaattattggtagtatagaacttgctaaccataggtttgtttacccagtgttctatttgaaagtagtttactaaagcattccatataagcaaagaaaaaaagcagcaaagtttcttttttgtttatgtgtcactgtatagtctcaaatgctgtaaatttacagtgagtagaaaatattcagaccattgagtcttttgcttaaaagatatttcgtaaggtataacataacgtttactggtagttttgtttcatttaaacattaggcttcttgagagttttaacagttttattgaaatgtaattggtgtataataaactgcctatggttagagtataatttgataggttttgatgtatatacacgattaggaaactatcaccacaattgagaaaataaacatattcaccccaaaggtttccttgtgcattttcataatttctccgtccctccacccctcctcacctatccccaggtgtacccattgacttgtctttggtccttatagagtagtttgaattttcttgctttctttcttgtcattatagattaatttgcatgtctttttgtaagtgaactcacatagtttgtgcttttcttatgtggtctcttttactctgcataattattttgagatttgtctgtattcctgtgtatcagtagttcatttctttttattgctgaatgatatcccattgtgtggatataccacagtttatccattcagctgttgatgggcatttgggttgtttcaagttttagactattaggaataagtttgctttggacattcatgtacaagtttttgtgtgtacataagctttcatctcttaggtaaacacccaggagtggaatggctggattatatggtaggtatatattttaactctttaagaaattgccagactgtttttccaggtgactgtattgtgttacattcccattagcaacattccagttgctgcacaacttcattaatagttggttttgtcagtctttttaattttagccattttactgtgtgtgtgatggtatcatattgtagtttttatttgcatttcatctgatgactaaaaatgtttaacatattttcatgtgcctgttttatcatccatacttcttttgtggattgtctgttcaaatcttgtttttaattgagcttttaattattgggttgtaagagttccttatatgtttgggatataagtgcttttattttttttttattttattttattttgcgacagagttttgctcttgtttcccaggctggagttcaatggtgcaatcttggctcactacagcctcctcctcctgagttcaagcgattctcctgcctcagcctcccaagtagctgggattacaggtggccaccaccatgcctggctaatttatttctagttttagttttagtagagatggagtttcatcatgttagccaggctggtttcgaactcctgacctcaagtaatctgcctgcctcagcctcccaaggtgctaggattacaggcatgagccaccatgcccggccataagtccttttaggtatatgatttagaaatactttctcccagcctgtggcttgtattttcattttttagcatcctctttctctctttaatacttttattgagatataattcacatttccttgagcaaaagttttaaagtttgaattctaatttatcattttttctttcgtagattgtgcttttgctatatctaagaaatatttgcctaacccaaggtcacacctctttgcttctagttttatagttttgggttttacttttaggtctgtgatacattttcaggtagtcttttatttttaatttttgtgggtacctagtaagtgtatgtatttatggattacatcagatattttgatataggcatgcaatgtgtaataatcacatcagggtggatggggtatctttcatctcaagcatttatcttttgtgttacaaacaatccagttgtactcttttagttatttttaatgtacagttaaactattttttactataatcaccctccactacccttcccagcctctgataatcatccttctactttctgtctccatgagttcagttgttttaatttttagcttccacaaatgagtgagaacatgtgaagtttgtctttctgttgctggcttatttcacttaccataatgacgtccatttccatccatcttgttgcaaatgacaggaactcattcttttttatggctaaatagtactccattgtgtatatgtaccacattttctttatccatttgtttgttgatagatacttaggttgcttccaaatcttggctattgtgaataatgctgcaaaaaacatgggagtgcagataacccttcgatatccaggagtgtcctaaatctaaggatgtgtcatattattttttctttatttttttctcctcctgctgttccgggtctctacagtgtcccctactcctttgttttattcgcacacctgggtagtgcctttccaatcaaaggatagttgggtctgcatttcaggtctgtgatctttatgtttagggaaatccgtttcctggtcaaagcctaccagacttccttggtatcactccagaatttaacagatttggcaagtatgttttttagttaatggtttgagatcataatcatttccttcatgctcctcctgccttctatttttgcttttaatattgaggaatgctaatggaatagatttgcttttgctctctcccatctttacctggaattgaacacatatttattgaaggaatgagtggtttgcaggaatgttgccattcaggtggagacatgtttctctttaaatatatagctggcaagttgcccatatggcacatagatattaactgaattatccactgagctctgggattaggagatacagattgtgtaggattgggagttctttctattggcttatcttttcctaaaactatgtaacgggatatgaatacctttctacctaagtatcttgtcattatactagatctagttttctgagtctcacttgtgaaagcttttggttaactattaataaaaaactgtacaaagggaagatgataatggtttctcttgtaaggtggtagtccaggggttgaaagcaagggttctagttagactgtgaggttttgaatctaagctccctcttctactagttatataacttgtatatgttacttaacttctcagaacctcacatttctcttcaataaaacaaggctaaacattttacttatagaattattgttaaaattaaatgaattaatgcataaaaagtacttaaagcagatactgtaagtatgcaagtaaagctactcaagttttagctattattgtaaccattttaattgttaattattgttcttatagataatggatgatgtgtttgaagctatcacctagcacaatttctgactaccaaatgtagtttgaggcttttgagtgtttttcacctaaccattcttcccaaatgaatatttttcagggaagctaaccccaggaaatgtgacacaatttactgtattgttccttacctctataatgtatgtttattctagctggttcatctcttccttatatacaagttccacagaatgatttttttctaataagaattaagaaacctttgttctgatgatgagcttatttaaatttgggtttaatttgatagaaaattaagctgtttccttaatggggaatctggccaatcaccatcctccaccctcccagggtagaattttttccaggaattaaatagctctatctagcagggtcttcctgcctttggcagtagagcagtacaaaggccacattgagcatagctgctggggaaaccctttttccttctctagcctataaatgctgttctgtctctgtgaaaagccctgacatcagctcttggaaaaatccaaatacttgtgttagaacaaggctgaaacacttgcctgggcagagactaatggctgaactatagttctaagtttaccagattgcctctcagtattgttatgctttaaaaaacaaaacaaaaactgtaagtttcagacataatctagagaaattaggatagaaaggacaacttaatagcgcctcccattctttgctagtttcttcttatttttctcttttttctaaaaatctaccttcaagataatgtgaaattcttgcttgaggagtgagggagagaaataatatatcaatattataaactttatgcagtgttttccacatattagatgctgcataagtatttgatgtttgagacaaaataaactgtaaacagactgtacttaacttccttagtgttcaaattagatcatgatgtaaaactctccagtggttttccattatattatgaataaactctaagcctgtttctgtggctcacattcttacattagctggcccctgtctacttctgtggatctcatttcagcactactttactactctcttggtcattttctatgcttaagccacagcggactttgtatttctcaaatacattaatctgcttatcctttgtgactcttgtactagctgtttcctttacctgtaattctgtggcccacatcttcccatggctggctccttcatttaagtctcagcttaaatgcctctaaggtcttttttgaataaactaaattaatgtatttagtcaaataatatctttttttaatagcacttaccacgatttgaaattctttggtacaattatttttttgtggagtttatcttcctcctgtggaatgtaagctgcttgagagcaaggaccttatctgttcattaacgtaacctccagtgtcttgaacctcctggcataggttggtgtttgtgtaactttgtatgtacttggctgcctgtaacggaaaacacaagtcaaactgacttaagcagtaacgcatttactggctcacataaaaaagaaatctagacgtaggcttcagagatttttgatttagggacgtaactatgtcaagggctcagatgctttccatctttacactcttgccatcaaaatcatcctcatcctaaactagtccttaaagatgaatgcgaagtagctgttaaggctgcttgcttcttcactcaggttcagtgggagggagagaaagaagtttcacatcattctctcaagaataaggaaatactttcatagatgccaccagtgaactttgtttctacttttattggcttttttggaaccaattgcttacccaagaatggaattactgttaggccaaaaaggcccatcactgttgctacagatggggttggcttgacctgagtcatctggactctgagaggaatagtagataactgaataaaatcggagttctcttaaaaggaaggctgtggtttctggggtaacttatatcctctgtagttctcaataaaaatgtatggaatgagtgaattcatgtagtaaaaatgtattgaattgtcaggcgtatgctcagcaccataatagttaagtagaatacaaaatcaaatagaatgtggtccttgccttcaaataatttaaaatctagtgagagagccaaattaacggaatattaaaattgttttaaaaatcagttgattaaaataatttaaaagatgaaaaagagaaaagggaaacaacagatgagacaaatagcaagatgatagacttaaatacattagtaatcacactaaaggtaaatggtccaaacaccccaattaaatgtatagactatcagattagatgaaacagcaaagcccaactgtatgctacaagaaacacaccttaaaattaaaaatacacattgtttaaaagtaaaaggatggaagaagatgtgccctgctaatctacattaaaggaaaactagaccacattaatatcagataaagtagatttaagattatagaatatcaacagggataaaaaaagtaatttcgtactgataaaagggtcaatttaaaaagaagacatatctaggcatgtatacacctaatgacaaaacatcaaaattcatgtaacaaaagctgacataactgaaaggacaaatagacaaatctacaaacattgtcagttatttcagtatccgtttttcagtaattgatcaaagtagataaagtaagcaaggatatagagtacttaaacaatactgttggccagtttgatttaattacatttttggaacattccagccaacaaccaaatactttttttttttttcatgtttgcaagcagacatgggacatttaccatgacagacacaattctgggctgtgaagtaaatttcaataaattaaaaggattcaagtcatacaaagtatgtttcctggtcaccatggactgaaattagaaatcaataaaagatctctggaaagtttccaaatattggaaaataacacaattcttagtcaaagtggaaataaaaaaggaaatggcaaagtattttgtattggatgaaaatgaaaacacaacatatcagaatttgttggttgccattaaagcattacataaaaacttatagcattaaacacctattagaaaagagagaaggtctaaaatcaatgacatcagcttcttttttttttttaagacagggtcttactctgttgcccaggctcaagggcagtggtttgatcactacagcctcaacctcctgggctcaggctgtccccaccttatcctcccaagtagctgggactacaggtgtgccccactaattttttttagtagagatggggtctcactgtgttgcccagactggtctcaaactcctgggttcaagcaatcctcctgcctcggcctcccaaagtactgggatttcaggtgtgagccaccgtacctgaccaatttcattttaagcaactagaaaaagaagagcaaattaaaaccaaagcaagcagaagaaaaaaaaaatagagatgaaagcaggaatcactgaagcagaaaacaggaaaacagtagcgaacattaaccccaaatctggttcttttgagaaaattaataaaattattaaacctctagccagctgatcaggatgaaaagagagaagacacacattactaatatcataaatgaaagaggtgacatcattacagattcttcagatattaaaaaaaaataggggaggctgggtgctgtggctcacgcctgtaatcccagcactttgggaagccgaggtgggcagatcacttgaggcaaggagttcaagaccagcctggccaacatggtgagaccccatctttactaaaaatacaaacatcagccggcattgtggcgcgaacctgtaatcccagctacctgggaggctgagggatgagaatcgcttgagcccaggaggtagaggttgcaatgagctgagatggtgccactacacaccatcctgcccaacagagcaagactctatctcaaaaaaaaaaaaaaaaaaaaaaaagataagggagcattatgaatagctttatggcaataaatttaacaatttagatggaatgtggttggtaattttataaattccaacaatatatatacaatatgtaaatatatattacatatacataaaacaggaaaatacataaaatatatatgcactctgtgtgtatgtatgtgtgtgtaatgaccgggtagggtttatcccaggagtgcaagattggttcaccttacaaaaatcaggcaatgtaagtaaatggatggtaaatggtggtaactatgtttctcactgtctcaaaggagctaagcaagagagaagactggaatgaacctgatggaattagattagaattagagatatcagtatgaactcatgctgagcttaatatagatacagatatatggatagctacagaaagaattatagatatgttgtattagtctcttctcacactgctaatgaagacatatccgagactgggtaatttataaaggaaagaggtttaattgactcacagttccacatggcttgggaggcctcacaatcatggcagaaggcaagtgaggagcaaagtcatgtcttacatggtagcaggcaaggagagctcgtgcaggggaactcccctttatataaccatcagatctggtgagacttattcaatatcccaagaacagcatgggaaaagacccccccccttcatgattcaattacctcccaccaggtccctcccacacatgggaattatgggagctacaattcaagatgagatttgggtggggacacagccaaaccatatcatgtgtatgtataccccagttagtataacacattcatttccctgctctctctgctgagagggcctagaaatggtgacatctcagtagcagtgagcgcacccagctcctggatcttggttactaaatatcactctccaataaaatagctccttggagaaatggttgactctaaggctgcaatagggaaaatgcaagttgaacctagagtgccttatagtgccacaaacaagaaagtgcccaaacagaagggtgagagcatgtcagtggcataaacgggaagaatttgagcaagagaataaataacgtagtattggattagaactcaaagtctaaaataaacatacatgagcccatactgataaaaatgattacataaatacatgggtgagaaaacacaaatcttccttacaggaaaatttcaaatagtatacgtagattcctattcccaggagatggagcttaatcctctcagatgctagtgtggattgggcttagtgacttcttcaaagaaaaaaatatggcaagggaaaaataataactttacagggagacgtcgagcaaccactcccttaaccaaatgaccaaagttaacattactagtgttaagtcatattggtgtcatatatcctctgatgggtgatgaaaagggtacttcacccctgtggtattccaaaaatagacccacgtatatatggaaaactgattttcaaaagtgcaaaaggcaattcagtttcaacaaacggtgctggaacaattggatttcaattggatatcacactctatataaaaattattacaaaatatattgtagacctaaaagtaaaatagaaagtcactcagctcttagaagaaaatgtaggggtaaatctttgtgatttggggttaggcaaagatttcttaggtatgataccataaacatgggcagtgacctaatttccaaataaagtcccacaggtatggaagttaagacttcagcatgtctttggagataacacaattcaacctgcaacaaatataatggttcccaattaggactgctttcatgtttaatacagagaaactgagaatctctatatgagtttagtgcttttcacatactacctaagaaatgcatcttccacatttacatttagtcttccaatgtgttggtgttgtcattaacaaaatacaaattctcctaaaaatattatgaattgtagctttgggcatttattcagtttgtggatagtataataattgctattatgtgtatccctgggttttgtttgtgtgtttgttttctactttcaacacaaatagggagagagtctctctcaccgatttcgtgccacactttgtcacttgggcattaaaataattttaccctggccctttgtcttacaaggtctgttgccaaaacaagcttcttcagcttctgctgctgtttccataaagatttgacatgagttcatggaattgatctcggggacgagtgtgtcctctcttttctgtttacctagtacccacagaaactcctgtcatttctagtccaaactcccacctggattccttactataaatgaattcatcccaaggaagaaatcaagggggagtatagaacttgggttacaaggatatttgttataacattctttattatgctgaaaaattagacccagcctaaatatttacaaaagggaacttcttaattaaatagccatatcacaggatactttgcagttatcaagaattatttagaactatgttttttaaatctttatctgatttggaagttcaatatatagaatgaataaaaaacaaagcagctctgatatgtgggaagtctagagccccatctacacactcccgctctgtgagggacctcttttaaacctctagaattttatagagcacagtttaaaaccagcactgtagtgaaatatttaatatgtaaacatatgttgatattttatgaagttaaagttgtcaatatgtccagtatgctttaatttttatgaaaataaattttaaacattgtatacagaaatctatctctattttgggaaagaatgggaatatatgcataacaatgctgggtgttgggattatgggtgatttttgtttactattttgtctttagtttttaaaagtttatacgtgtacttctttggacataaagaaagtgagacatttcttcatattgaaaaggcagagagaaccattgctttataggaaactacagtttggaaaaacggcagtctcattactcaatcccttgagagaggaattatcttgaaaatgttataaaaaatattagtaacagatttactagtgtcagtggtcttgtgtgttaagtatattaggataagccacatttgtaacagctaacggagaaaacataactgaatgtcagtgttacacagtgaactttgtagagcagtgattcccaattctgagatgttgtaagaggaatgtcagaattcctaaaacactcatcctccaacctttcaaattcagtgctgtggtgagccattgttactgataagggtatatcccacttgtgatttctttgttttgggtcaagaaaagcttttgtagaagccagtgtaaaatggcatgcatataattaatttcctcatcttttcctcataaaatcagaggtccttttatcgatggtggtttgaaagtctggggtattcagatttggcagcagaaagtgtgttttttttgtgtgtgtgtgataaactaggtggattgctaattctgattgaggaattcgtaatgtttgacaccagaaccagagcacttgtgaaaagaagtctctttagtacaaaaccaaaaatttaattacagcatttgttataactatagccaataaaagtatttttaatgaaaaagaatttccgcagaagaaaatgctttctattaatgcagaaggtgttatatagaagatttaattgtaatgatattggttatgatccgttttttgttttatctttacctgtattttatattcgtataacctctaaattttacaaattacccataatacatttcttatataattaaaaaaattctgagtacagaacaggaaatatgttcaatctttattccattagagttctacttggaaagtattaatatgtaaggtttttatttctccataagaaatagacctatatagtcaggcacagtgtctcatgcctgtaatcccagtgctttgggaggctgaggcttgaggattgcttgaggccaggagtttgagaccaacctgggcaacacagcaagacctggtctctacaaaaaaattcttaaaaaatttagctgggtgtggtggcatgctcctgtggtcctacctacttaggaggctaaggtaggaggattcccttgagcccaggagttcgaggttacagtgacctatgattgtgccactgcactccagcctgagtgagagagtgagacattgtctccaaaaaaaaaaaaaaaaaaaaaaaaaaaaaagaaaagaaagataaatagatctatgtctagttaattcgaggagatggtacacatttttagagcacatgagaacgaagtttatacttttctgattttctgggtttccttgatgattttttggcaaatccttgtctgtttagctgtctggcatatgtatgactgtggttgggcttctttgtactcaaccaatgaatgcataccaactgtaacacctgaaggtaggatcatgaataaatactctgtgatttggggttagtatagttttggttgttttcccttctcctgagatttcagaaataaaagattcctattcctgtgatttttttggcacacagtaagacatatttgatacataagataagtcattataattaacttgtcgaatcactttttcttgctgcagaatgatatttttatgaatgccttaggttttttcaataaaaaatgcaaccaaactgcaaatgtactgtgatttaaagtggtaatgtcagaatttaaattttgagtagtactctttttttaaatcatagaatgctctatgtttattcaaaaaagtaaaatattattagacagtattttttattttaattttgcatttaaataaagttctcaagctcagactgaaaagtaaacactgtatgttggagcctgtctcaacgacacttaaaagctaagactttctactttttcagaagtacatttgtatcttttggcaaatgtgtagaaagcagcctgtcctaacaaattttgttcacctgttctcacttcagtttatagattgttaaacatttaatcataatatattttatatacaatatttatgtgaaaaatgcccatccttgattaaggggatttttttctactcttatttttattatttttaccagtatattctgaagtagagaaatgtgaaatgagatgaagatttaaattcctagcaaacagaatcatgcattgcccctgttttataagtaatgagatcattttgtagagtccagtttatttacatttgttaaatgatattaatatctcttccataagcatgaatttggtggtttgcatggtgttcactgaggtgaggatacttgtttaagtattttgaggatctcatactttcctagcagttctttttacttggttttctgaagtgaatatagtctttaaaaaaaagtataaggtactagtaatcagatactcatgatcacaaatgaaagtggtggagaaaccttttaaggaatattcacaaaagtgataattttccagattgtcaatgaggaaatgaaagtctctaataagctgtcacattaattgtgagctgcatttctcagtcagcaacaactaatagtcaatctataatagctccagcagagggaatgaaagtaatttagaaaaaagtttactatttgatttgtcaaagtgtgtccaggaagtaagagagcctaaccaaggggctgttgtgcatgtaagctcttcagtaaaagtggtggtgtactaagctatatttaagaaggtaatttgagattttatattacatgctagtgaatcatttttggattttgcaccagaactgagctctttggtccctgcctgtctgtggtttgtgttgcaaggtccagaggcttaaaacaaagaacaccatgggaaattctccatgagtcattccgtcagctgtagcttctgttttatagtccttcggatataactagtgttttaatgccagctctcctagccgcttttcatgctttggttctatatgctaataaaaaagtatggcagtatggctattgtagataacgttcagacttttttttctcccgattccacaatttttagttcttctaatggctctaagctagaccaattataaattgtaactggtgaaaagatttatgactgtttattttgttgtagttgcgaggtaagcgagtggtcacttaatacttttggttctgtgaatcttactgtccagagaactaaagattgaattagcagttcagctggagtcagcactatgtgctaaatccctatacttaagagctcttatgtattgcagacaaatgtcctcttagctgttttgttattttgtgaaaaataataataatagagcaaggcagtttagattcatatcagtttcaaattttaagtaccatgttttaagccattctaattgttttgtagaaacagataaattaaaaacttgatttaaatccagcccacaggatgccttaatcacctttgatattttaaaggagatgaggaaataatggacttttttgctagtaagtggcaggtatggtcaacacaatttcactacatttgaaaaaaatcactttccctgcttgccaggaaaatttaaagtgcagattgtaacctgatcttttttcttacagtgtaacgtctgagaagttcaagtattgacatgaattttctatgataccacttggtaaattaaatctgtggtttcatcactggctttgaattatatatttctatgcattttacttagctaaaaacttatttgaatatttagtctttaaatttattttttcttttctgcttatttgaatacatatcaccaacattcagattttatttttgtttttcttaatagtaaatacataagtggttactgcttgctaggcaatgcttcttattttctaatttaatccccaaaacaaatttgtgaggtataggtagatgtattagtaattatgttttagaggagatgcttaaagaggttaagcaacttgttcaagttcaaatacctgttaaattatgaaactagaatattaacccagttacatttgtttctgaggagtcttttgcccccaaggccttgaaattttagggaattttcatttatagcaatcaataatactattcccatcccaccctgtccatttctgattttcaatagtatagtttctgcactgatatttacatcgtcttacgatggttgagccttaaaattacctgcattgttgtctgatttgcaattctttgtctagtaactcttctcactggagtgggttccaataaaatggtgctgtatttcactcaaaatcaagttgcagtgttttttcctcctcattttaacatcactaaaatcagagtgtatctactaatggaattcttgataattctaaatttaataggtaacattctttgactgctaataaaatcttaaccactatccaatgtaagaaaaatttgtttaaccatctccccttcatttcaaccattccttattaagaagaaccaactacagtctcaaatgctcctttataactaagcccagggaagacatatctaacaccctagaggagagagaaaagggtatgaattaaggtttgagtgtgatatcagcatttcttctcatatggcttcagaacacttctcactgaagtattgtcaaaaggctctttatgcactgaaatcaataaaagaaaaaaacaatttctagcaggctatttattataagcaaatatgtgacgacacaaaactttctggtcctttgcaattttttaagtccaaaagaaattctgtttaacaatattaaaggactattccagttacaaaattgtgtgtttgtgtatgcttattagaataattaaacttggttaaaatgtaagtcttactctagtatacattatttattgggtaagtgttatttaactaccaaatcacatttccctctacactgtaataacacatcgggaagggccacctagggctttaaaattagaactcagaatttaacaaggaaaaggtattctgagttgagtgaataaatgtattctgaacgtttaaggcctttggttaagatttctaaaatgtagctgtgcttaatatacaaaatcaaaagtaaaggcaggccaggcgcggcggctcacacctgtaatcccagcactttgggaggccaaggcaggctgatcacttgaggtcgggagttcaagatcagcctggccaacatggcgaaaccccgtctctactaaaaatacaaaaattagctgggcatggtggcacgcagctgtaaccccagctactcgggaggctgaggcaggagaagtgtttgaacccgggaggtggaggttacagtgagctgagatttcaccactgcactccagcctgggtgacaaagcgagacttaatcgaaaaaagaaaaggaaaaaaaaaaaaggcatctagccaccatatcccagtgattcaaattcctgataattctttgctttattaatcatcgttcttcattttggaatttgacttttttgctatctgttaatagaaaaatacacacacacacatataagtaaacacagtatattcattgttgaccaagtgtccaagttatcaatatgatattttcaaaaaccaggcacagtttcattaggcacctgtaacattatgtcatagtcacatacagctgttctacataatatcgatccaaaagatattgtcatgatttcatgattagactacacagtggacagggacttaaaaatataggagttttgttcaccagaatgtatttcatcagactaatggttgaactgatttgttgcttatgacctggccactttgtagctttcagacctgcctttctgtagcagttgatagtatggattatctgatcttccttcccttctgggacaggcttttctcttttctaattcattttcttaatctcctacctccattctcaatcatgcagatgctagtttctcccccatatttgagcctgagcattttttcaagtttccttggtgttttacatttcagtgaccatcagtaggttgataactcaaatctgcaactttagccccaggctttctttgaggttctagctttctatttccagctctctgattacatctgtctcaatattcagcatgtggtagggattttgcaaaactatgggattatcttggtgactttcctagctgaagcagagagaactaatgaaatagccaagaaggttcttgacattgttacttatgcatataagcatatatatacacacatatgtacacatatatttatttgctttagcagatactttaaagtagaattcaatgattagagaaaaaattatgattttaatattatttgagacgttcttaatctatacttgaagtagtaagtagattatgataagcaagttggactgtgggcgtggtccttgttcattttctcattccgtttttgtccccatttttcctctcctttttcattaccttgtaagagaaaatagctcaggaaacgggtttacaatcagtagtctgggaacttccgggattctttaccagcatccccctggatgttgcagtccctgacgcaagcagcattgttttagggtaggagtttttataatggctgtgaggtcgagtgcctaaggttgataaatggcagttgttatcctttgcagaaactcagttggaatcctttctgtcaacttgtatgttcatctgtaaattaagaaacatgttcccattccctccctctcctacctcaacagttatggacagactgcttaggaactcctatttctgaagatttcgtggtcttttgtaaagtcagtttgttctctagagcagtgtcatcttgtcccagaaccccctttacttactaccactacttctttgtaagttaacatgctatcactgattaggaaaggttttagattcttagtctttttctatggatcaattttggtttaaataggtgtcgaagggaattgtaagtcagcttgtattttggaggttttgtttctacctccatgccaaatgaaatgtagtcattgaagtatcattgtattatgtttatttctgtctttactaataggcttttttaaaaccctagttttactgatgttcttaataaagtacggttcctattactaaataatctttacataaaatgccataggttgaaataatttaaaagacagaaatcaaaatgtaggatgatatttgagaagacttagattagcatttatatatagcatcaaacgcttatcaagaagcttccggcagtattcatttaaaagagagagaaccaggaggaaatgctgtagttctttcagcttataggacccccccagaaaaacaaaacaggaaagtgccctttgttttctacttttggaaggtattttttgtaaccgataattactttaatgttaatttttttctagataatctgttattaaatctaaacctaataattgaggatcacgatgacatagatcaatagtgcagtaatcaacacccagatattttgggaagtagtgtgaagtgatgggaaggaaggaactttcccttctaggaaaacagtgagaataatattttaatggcaaaatatttctttttgtcttgatttttaaaaatctataaaatggaaagtatatctcttcatagagatttctttttttcaagattaaacgagataatacatgtggaaataatgcatagcatttggtaagccctttataaatttagcaattgctcttattattgggatttttaaaaagaaaagctatattctaggacagctgatggtaaatgcactggcagtttaagatttaacaaagtagttaagatacttaaacatggtgttcaacttcttattcctccagcttattgattcttgctattggaaagttaccataagatttaaatctcttattctggttcagtaggatgaataaatttagtaacaaaatcttacaagtaaagtaactacatctatccttattttttctttgtttcaggtttcccctcaaaaaacctataaggtaagtttgctcaattacacttcatactcaagtttaggttatattttaattataagcatccctttgaaattatggtggatttttgtggtttttgagaatgtgtattcaagtaattcaaaatttcaaaatgttttacaaatttaaaatgtaaaagatgttactttttctggaagacagcattgttttgataatacttctaatataagcatttaaaaattttgttcaaaaggatatttaaggtcacactgaagagacttaattttgaagtctatttgtgactgttttgaattatgagtagcttaggaggtgaaaatagaatgctagtttttgatgtgttttatcacttgtgtgactataattgcctttagttaatgtactttggtactagtttagtcttaattactttattttttattttattttattttattttttgagatgggatctcactctgttgcccagcctggagtgcagtggcgcgatctcagctcactgcaagcaccgcctcccgggttcacaccattctcctgcctcagcctcccgagtagctgggactacaggcgcccgccaccacgcctggctaattttttgtatttttagtagagacggagtttcactgtgttagccaggatggtctggatctcctgacctcgtgattcgcccgcctcaggctccgaaagtgctgggattacaggcgtaagccactgcacccagcctagtcttaattactttaagacagtgaagaaaaaaatccaaaatgttaaaatgtatctatgcctatatccatgtctatatatttattcatttccaggtcttaaatgcctcttcctcagtatttttgctttcagcatttcttctgttatcttatcataaatattatttaaaatgtaggtagtatgtcattcctaattattatattttatcatttttagtgtcagcatagtccaggatccaatgctaaccttggcatttcagtgaatatgtgtatgtgtacatatgtattattgttatggtcttgtcacccaaccattatctgatcagtgtaattggctaagccatagaagtaataataataataatgtcattggtccttaaagtggttggctaagacttctgtggctagaactacatcagcaggcttaaaatgaggcttgcctaaggctgctttttaaatgttaaaccgttctcatgcatgctctatttatgcagtgattttgaacttgatcatagtatatgtagagttggagaatgggtttaattccttttaggcactgtgttttttttgtctgttaaatggaaatgatagtattgacctgtgaaaaccacacaaaaaaaatgtaagcagttacttctgagaataaaagagactttaatgctgaatactatttttaattattttaagcagtttttataatcaagtaaatagactgtgtataaccaaaacttattgaaaaatgtaaattagagaggcttatggtgctgtgtaaagtaaactgatttcctggtttttcttgtaagatccacttttagaattttaaattttttattctaatgattttcttgcactaagcatttgattactttgctttaatttaggcatggaagtattttgaaccgagagtcaccaacagataagaagcagaaagttgagcgcattgcatcacatgattttgaccccacaggtaaaacactattcattctttcaaagagtattgagagtagtgaagttcagaataatagagcttaagctacccgaaacactcaggaatagttgtttgatctgttttaggactctcacattcctccaattatatcataataaagcctttgcatttagtaggaatgcaagcatttttaacttccaacactgtacattccactacagaagtatcattgtagagtatattgtatctttaaatagtgataataatagaaatggttatataataattggagatttggtcagatcaagaactcagtgttaagttgaatcatggtataagcagtaatatgtcataaaaccaaggctctaacaactcgacacttgcgtagtcatctaaaaattcaattgtgattatggtgaattggagttttagataaatcagtttcacaaattaatgatggtctcattttagagtaaacaaatgaatagaaatccctttctcttcagtcaaaaagtattctgaacttaaagagctgtctttcaacctaagcagtgtcgatctttcctagggttgtcaccttaacagactttcagattgatctccttttaaaacatctaggctttttccttttgctttctccttgtaagcttactccatatttgattcatagaaagtgcttggtaatcttgcttttttcatttgaaactgatatatattttttgtgcacatactattttattcagttgcctgtccctttgacaagagacgaagtaaatcccgctatctcagatacataaaaataatgtatctatttttaggtatttttacttagaaatataattttaaatatttaatagagaatagtatgttttatttatctaagacatttcatactttattagtataaactcctttattttgaaaaaatattataaatattatctaggaagcacatagataatcattttctgcattttgggtagtaggtaaaatgaaattccaatcatcaatttaggaggctttggtggtgggactatgtattatgtcacttacagatctccatgaagagagaattttccattctgatgcctaattttgtagtcatggggctcagaggctttcatttacatgattaggtattgtcttgccaataaggtcaaaagtttctgccctatgttcagaaaaatataatcttgttaggtttattttgtatctacatctgtgctgtgcccatctccaaagacagatttaagcaaagatgtatacaatgcttcataatgagatcattatagcttttagtgcttttgtcatctctacaattatcaggtgatatattttgtatactattcatgtgttgttttgtttgaacatatttttattgcactgtcttttcttcgataaatctttaaaatatgtcattacctgtgctgtttgtgactattctaagtgctgtcatctgttatgttcatactttgtgtttgcacgatttaacttgatcatgattcattcttttttccccatgaatttttccccttacattgtctccatattttctatatctctctccttttctcccgctcttgtgcagatagctcctccaagaagacaaagtctagttcagaggagagtagatccgagatatatgataagctaatgtagctaattcagccttgccctttggagcttgcttcatggtgttccttttctgttctttttttcctttctttctttctttttaaataactgcagcctttcttgtgtctgctgtgcatggcatgatctactgcagggaaagggagcctggggttttaacgtggctgtgatgtggaagcttaaggttgctagaaactaacattgtagattaagagtaggccacattgcccatcttctcccgtcttgtttatggtaggaaggtgattatctctaatatgtttgggtcaggttcctccaaataacatgaatgggctttgaattcttgtcatcttcttcccacatctcatttgcagagtttggattatgaagaatttgaggaattaagtcttttcctctaagtataatactggtgtaatttagacgtattagcagttctttggaatttttatttcattttttgtttgtttatttttaattgcctcgtcatgtggaaaagtcattcttgtataatttatccacgatggcaaaaatacgtaagtattttatcttcatagcttgaagaatttgtgcctttgagaagtttctctgaagcttaatcggaatgggaaaatttcagaatggtaccttttaaataatcttaacaaagagcaagtttaacctgagtggtcaacttttgcagcagatgattgaaatgctaatatttctagactgtgtcctgtcttccaaagatacaataaccatgtttgtgaagttcatacctatttttccttttcctttgcagttttatttgccctctttccttcttttggagtctgattagggttttgttttggggtttttttttttttggttttttgttttttgagaaaagtgaataagagaggaattacctggagctaagattttaaaaataatttctgaaagactgataaattatttctttttttaggaagattccaaatttggcctcgaagggaaatcaggtcatctttaatagagccacaaatctatagagcagaagctcccccaggtgcagatagatgtttcctagcttgatatataggagaggaaaaaatacaggaattgccctcccctttttaagacatttgataattcacatctgctggcacttgagcccatatcagatactttttagtattatgaaagctcagtgtttggttctaaaccagttaattcttctatgttagatatatacacatagttctttacttgggtttttgtgaccagtgctttttctgtgtataccttttacagtagttcagcagtaaatgtatactgtgccttgtgacacatcaagtttacgctttttcttccttccagagtattttggctactgataagtaagaactacctaattcctggagactatatttctgttctatataaagagctttctatagtttatcctctccttaggaacatgaacattatctttatagctctattctttttcggtagcctttgcagtgttctatttcgtcttcctctccattttcctagatctgcgatgtgtatttagaagcttgttgtatgctttggatgaagactaacaatttaggaacctctgactagaaatactatactaatatttttcttagcagtgatagaaacattaatactagttcaggcatgccattggcttggtagtgatagaaacattttaagtggtaattgggaagtaaggtgtggcttctctgtgtgtttgttttttgagaacccttgaaataccttttttggaaggaactgagtccacaagtcctcaaaaagcactcatcggagggatgagttgattagaacagaattagcatgctaacgtaaatctctttgacattacaaatattttatcacctgtgtgaatagacgtctttagattacgtacagttagcatagatgaaaaagtctctctggggattcagaaaagcttgaaactactgagtagaatcatagcaactggtgacattctgctttagtgtagggtcttattataagcccacttcaaactttagagattatacattgctttctcggggtaaaattcattagctgagtacttaacaaaaatgctagttactcacatattatttattttaaactttcttggcttttttttttttttttttttttttttgagacaagatctcgctgtgtggcccaggatggagtataatggcgggatcatgactcactgcagcctcaacctcctgggctcaagtgatcctcctacctaagactccaaagtagctgggactacaggtgcacaccactgcacccagctgttttgtttgtttgtttgtttttttaatagagatgaggttgttgaaggaatgatttgccaggggaaaaaaaaaaaagaaagaaatagtagagacaaagtctcgccatgttgcccaggctgatctctgtctcctgagctcaagcagtcctcccaaaatgctgggattaaaggcataagccaccgcacctggcttcttagccatttttagagctactttgtgaactagatttactttgtgcatcttaaaaggaaaccaagtgtttgctttgtattgactttttttgttacatttctgcccagtgcggtcagttggttatttattccatttccccttatttgtccctttctacctgttagagtctattaaacgtgtatggatgcgttttctgatctacaattttaataatacttaattttattaatacttttgtgggttactgtaggaaatgagagattcagcaagggaattctgagttagaccatagctgctgcttaaccgctgtcatggtgtctgaacagattcctgctaacagtatttggttcaagaaaataagttatgtctttttaaagctgtcttagtgtgttcaggccactgtaacaaaataccatagactgcttggtttaagcaatagaaacttattttctcacagttctggaggttagaagatcaagatcaggatgtcagtgtgatcaggtcagaagattcccttgctggcttgcagatggctgccttcttgctgtttgtctcacatggcctttcctccgtgtttgccaatgccctttctttagtttctatgatattacatcaacctggttctttattctttgtaattattttgtctctctttatttgattgttttttccctcctgttttatacatgtaggcatgacccaagtttctgtccccaatctttcttccagtctccagtctaagtgtcccataaattcagagtgaccaaactggagttcatcattgttctctacagctggaaatcagtcttcctctttatttccctaattcttataatgacactgtcatttttccactcacctagtcttatatttccttaaagttatatttgacttctccattttccgtcgtcccctgtggtcagctatttgccaggtccccttgattctaccatcacaatatttttcatccttcactctttggtttcaaccccactgccttgtccatcattttattagactattataatagattcgtaacttacttttatttcagtttcacattgattcattaacttttctccattctatattctgccttgacttgtcagattaatattactaaagtaagaatttggtcattcacttgctaagaaagtacaggtagttattaagataatgccacaatttgtttccaatttattctactctgattctccttcagcgtttcattttccaaaacatgttttggcattcttcctttgcacatgccatttctgttgtcttgagtgaattaccacctataacttagaatcctactcatctttcaaggcttaattcaagtactgccttttcctaggattgcccagctacttttgttgtttctgaatgttgacatctgttttgtatttaattacttatatttatgtttatctttacatctcccataatgctgaacatattggagacactcattaagtgagttttgaatgaatgattgttgagattgacataggaagtattttagtagagaaaattgatggaataagatcttcactcatcctaattgaatctttctttccttctgaaaaacttgaagatagaagaaaatgtaacttggagacatttttctggtagtggtctgaaagaatgaaatcagcatacttggaatttaaggctcttcttgctggcaagactgtgcatttagaatcaagaagcttcttaatcaaaggattatctgaggtcttactcataaaacatgtatgtctggcaccagtttaaaatgagctgtttttatgaggttgcacatggcccttctccactcccttccctgaagctgattcttaagagctgaaacctagagaagtttggtcatgaaataaaataaaaggtgaagaaagactaatgtgctttcactaaagtcaatgtaatatggaagatttaacaggttatcttacatgtttaacactccattttcattaatatgccccacaccctattttcattataggagttatggccttctttcaggaacagttatagaatgacacttcatttttttttcactttcaaaatatgatcattggtaattatctattgagtaagaaggaagcagtctttttatgttggttttaagtgccacattgtaataacagaaaaaatatgtcttttgttatgataaggaaataaaagaaatggatagtatttatgtaaatttgatataacatctttacttcactgatgagatgaagcatgatatcaggtttatcagcttctaggcaaaatatgatttttaagagacaggaaataaagtttgttttgtaactagaggagttattttggggtagatggaaaaatcaaattattatagttggaattttgccagggcagaaggttaattagcgttcttatagaaatgttcctctactttgcatagtcttcaaggctgtgattttttttctaattagaaaatgtttgagtattttatttaaaatttcctttgtgtataaaattcaaatttatttaataactatttagtgagcacccattacatgccaggcactatactaaggcatagagatacaaagatataagtgactctacctactttctggttgttcacagtctggtacaaaagaattgcaatacattttgataagtgcagtgatagagatatgcactcatttaccattactctatatgcacttaaaaaaacagctgtgaagaaatactcatatggcaccaagaacaatgggacggaagaagtattactaggactaagtcttttgtttttttgaaaaacgtgtttattattactgttattttttgtagagaagaggtcttgctaagttgcccaggctgtgctcaaactcctggcctcaaccagtcctcttgccttggcctcccaaaacgttgggattacaggtgtgatccacggtgcctgcctgtcaggattacgtttgaaggaagtttaactttttataccagtctcactggttttactttttgaacactctgcctgtgtctatgcaaagtgctggcatatagcacatatcaaagtaattaggtggccttacagaactcatattcacagatagatacatttgtatggaagttatgattaataatctttataccagatgataaaggatttagcaacaaaacaaaaccatggactatatgagttgtagaaatcagaaaaagtaaaagtgatgaaagctggtttttgggtttttttttaattaatgaaatttgaagattgctattttggagttatgagtctacttttatctttggctttctctgtaacatacagggcctattttctgtaccattttctgattcttaaacattgtcatttttttctccatttgttttcagtattgtcctgccaggattttatgttctttgagaacagaaactccaagtagtcttgggttcttcacagcacctatgaactgcagtgttaaataactagtatggacagatgctcaatgcaaatttgctaaaacaaacaaaagaagtaggatttttgtgtgtgtatgtcaaaaaggatagtacaaagatatgataatgtagccagtattggtgattttagttctacagagggtggaatttttccctctgtggtaggttaaaacagcttctggtcaacaaatagaatatttctctgaagaaaaagggaaaacatttcatttgattttgaatgagagggaacataatagatttgagcatttgaaggactggatttctgaattttgaatggtaggatggcttcgttttcagttaattattaccacagatctaaatttatgcagacaccacagatagacaggacagaatagtattgttaatttgaattttatagattctgaattgactgtatgtgtaacactttttatattggtctactgatttaaagtacatgttaaagtacatcaatctcacattagcaggtaaatataaaataataaatgtggctaatacagtggatttggggagaagaaaaaattgaataggatgtgtgcatagttctttttccttttcctctttattctttgtccctcatctccttttgctgtagaattaagagggaaggttatcagactgagactgttatgaattggagataagagatttgctgtattctgaagtaatactaataggttttcttgattcttattaatctgttaggattctaggcatatttataaaattgactgtgcatggtgctgtttttttctctccgatgacctccctttctgagcttcctttcatctctagacttgtctacttgtctgaatttcattaattcataagcaatttttttaagtttccttctgtcccagaatacatgcaaggttctgagataagattgtgatgaagatacagcccctgcacctttggagcataaaatccaatgaaagaataaaaacaaatacaaatcagtgtgagtaagggtgatacagtaggagtacacagagggtgcagtgggagtctgtaagaggggcacctaacttcagtatgcatatttaggaaaagcttgtaagaagactgattcttttcttaaggacgtccagctgtctctcatcttctaaagctgcctataacaagaagctctgcccttttaaatttcccttctgtcttccttacccatccaaaactactttccttgtttgctaaaaaacaaaacttagacataaatcataattgatcctcttttttttttgagatggagtctttgttgccaggctggagtgcagtggcgcgatctcggctcactgcatcctctgcctcctgggttcaagcgattctcctgcctcagcctcctgagtagcctgggactacaggcacgcgccaccacgcacagctagtttttgtatttttagtagggacagggtttcaccatgttggccaggatggtctcaatctcttgacttcgtgatccgcccatctcagccttccaaatgcgcccagccagaattgattctcttaaggatcatttgcattaattgataggagtttattaacataaaagtacttacaattgtactagtagcatggatagaggagaaaatccaaggtcaacctccccttaatcataataaaataatatttaacgtgtaggaacccttaatatttgttagacattaagctaactactttatatatttttttattcaagtgagaggtgcaaacatagcaaactccttgactccaaatacccgtttccctcatgttttacaggtgtcctgttctctgcaggcatctgaaaaaaggtctatttaagaagcccaggttgcttagcactgcagtcacccatattagaaacctttaattcattaattttcagcttttgtgaggtgaggtgggagaatggagaagcacgaatatagtatgaaaaaacgtattcagtgttataattgccttgatttctaaagtcacagtatctaatttattttgaaatttcaaataactataagggaggttgtgaaatatttgtttccaaaagcaagcatggattttaaaaggttcctgtaaaatgctgcttagtctaataattttttttttttttttttttgagatggagtctctcactctgtcacccaggctaggctggagtgcagtggtgcagtctcggctcactgcaacctccagctcccagattcaagcagttctcctgcctcagcctcccaagtagctgagattacaggtacctaccaccatgccaggctgattttgttttatcatgttggtcaggctggtctcactcctgacttcattcaggtgatccacctgtctcagcctaccaaagtgctgagattacaggcatgagccaccatgcctggccagaatctctgattctatttattatatgctagaatttataaagaatgctttttttaaacttgatttatatattcatatcctattttataggtgtcctaattacttgaaggaagtaacactgaacagataacaaaggttgaattctaatgtgttatcacctgacctcattacaatttattgttttgtgagagtggtgaatatgttatttagtatttagaagtctctagaatttaggggtaacacatttttaaatgttgaaaatcaactttattgaggtaaaatttacataaaataagatgcactaattgtaagtgtatggttagaaaattttgacaaatgactatgcatactcatgtaaacattatcttaagaaacagaacatttccatcactgcagaaagttccttcatttcattttgcagtcattcccactcctcttccgtgcttctcccctaggcagttgctattctgctttttgttgttttagtttagtttttccttttctatgttggagtcatgtagtgtttactttcttacatactggtttcttttgcttaccatgatgtttttatgtttcatccatgtttgttgtatgagtagtccttttcttccttcctaatacattgtatggacatacgacagtttgtttatccattcatccgttgatagacatttgagtttctagttttgggctcttatgaataaaactgctgtgaacatttgtgtatgtctttctgtggacacaaattgttctttctcttcagagtaaaattaatggatcatatgcaaatatatgcttacctttataagaaatttccaaacagttttccagaatgttagcacattcccaccagcaatgttataatgttctaagagttctagttgctccacctctttgctaccactgtttatgattagccagactagttggtgtatagtggtatctcattgtggttttaatttgtattttcctgacgactgcagctgttaagcacctttacatgtgcttattggccattggtctatctttgtaatgtgtttatttaagtattttgccccctttaacatttgtcttccattattggctggagagttgcatataatctggatacaaattctttatcagatatccatattgtgaatattttctctgtggtttgccttttcattttctttttctttttctttctttttttttgtgacagagtctcgctctgtcgcccaggctggacccgcctcccaggttggacccgcctcccaggttcacgccattcttctgcctcagcctcccgagtagctgggactacaggcacccgccaccacgttcggctaatttttttgtatttttagtagagacagggtttcactgtgttagccaggatggtctcgatctcctgacctcatgatccgcccttctcggcctcccaaagtgctgcgattacaggcccggcctgccttttcattttcttaccagtgtctttagaatagcaaatgttttaaatttttgtccagtttcctaggttttttttcttttatggtttataaacccaccctaaggtctttttttaatgttataaaatattttgttacatgtattttatctgttttctttttctttctttcttccttttttgtttttttaataccctaaggtcttgacgatttccttttgtgttatcttatgaaaaattttagcttatgtttaggcccatgatctgctttaatttttgtgtaggtcatgagttcaagggttaaggttcatgttaagctacagtaggctcatgtactcatgatgtgtcattatcagcaaaaatagatatgtatatacactgtgtgtatatatatataatttgttatatgtatatgttttctatgagccattgtacacacagtctatatatattttttattaacatatctttagcatatcgtttggttggtaaatcagacttatatttaaaagattgtggctttttgtataaaaatctttagaaaaagtttttattttctattcattatctttgtgttgttttacctgttttatatattgacttcggtgaaatgcttagatcctgcaaagctgaaaatatatgttgtctctggctaacacagagttcaagatcttcagatctggtctatgataaaacagccctgggtactaatcagggttctaccctggcaggacatttctattcctctggctggggccctctttctctcaccttgccctgacagttttcatttgctgtttagaagaaacacaaattctcccttaggaatcaggtaagtatatgaaagagatgaaggaactggttgagctcacagattctttatcttttctatttttttctcttttctgtttctgttttctataagccagggtttttcttccccctgaactcttcctttctcttcccttctttggggaataacttcaggtactctgtaagcacctcctttctttttactgttttcctgagtatattttcttgagagtgagactggatttctgcagaattttccttgagatgctcctagccccatgtcctaagatggttgatttttcttgggttaaacaccaattagggtaccaaaaactcagggcagtggggcagggggagaatttttttactacagagaaatagcatggatgtgaatgggctttccttctagctgtctcatgtctaatacttaatattttgcagtttgccatagctgtttttaatattggagcaattctattatactccgccagtgagaaaacagtatgtgtgactctgtggtgttcttgtgtttgctttgttgatggtggttagtgttcttattttaccatgtggatttacatgtgctactttttgtttctccagatggaacacagtttattactaatatataattattgtcttttcctttctctgttttctcttccttcttgttttacactgtggttcttgtgcaggtcttgttcagcgttgcgtaatcatccagaaagatgacaatggatttgggctgacggtcagtggagacaatccagtcttcgtacagtctgtcaaagaaggcaaggcattttaaaaaacaatttatcactcagtaaacagagtaagaatagaaaagcttaaataatggcaattgccaagaatagaataattacatagattgcaggtcatgtggactattgtgctagattcgtctatcatgtcatagttacaggaaggagtttactccagttgatttttttttgtacttgttagaaagaaatcagtttttatttagttttagaaatcatgtgactccttggtcatgatactttattgtccacacaaaagtttctgaaatttcagttttccatggcaccactgatattttggcaaagacagattaaagagatagctatggcttcagaaataccatttattttcccaaaacaacagtgataatattttctactgctgttaccatatattgaatacttcctttatgttgggtgctataattttgaggtagacaatttttttatccccattttataggtgatattgaggcttagagtaaagaaacatcaaatcagtccaaggtcacacaactagtgagtggcagaagcagcatttgaatgtaaagtctgactttacagccttgttttttttttttgtttttttttttttggagatggagtctccctctgtcaccagactggagtgcagtggcacaatctaggctcactgcaacctctgcctcctgggttaaagcgactctcctgcctcagcctgccgagcagctgggactacaggcacgtgccaccacacccagtgaatttttgtatttttagtagagacggggttttaccatgttggccaggatggtctcgatctcttgacctcgtgatccgcccgcctcggcctcccaaaggacagcccatgtttttaaccagtttgttatactgtctctctgtcaggaagatgatcagtaaatgcaaatgaatcacattttaagcaattaatttctcatacagatggagcagccatgcgggctggagtacagacaggtgatcgaatcatcaaggtaaggaataggctattatagaatttacggtaggattaaaaaacaacatatattggtcatattctgatttttttcacttggatttttataaaaagcatcatacttctatgtatgatagatctgttgactatacaaacttatttcatttgttttaaaattaatactaccctttactgaaggacgtaataaaaggattgaaaataatggaggaatatatgttcttgagtaggagagtaattcagggttggaaagatcatttctgtctagattagtctgttattaagcaattctcatcaaagtacaagttgaacatttctaatctgacacctgaaatgctcccaactctgcaagtttttgagtaccaacatgacaccatgaatggaaaatttcacacctgacctcatgtgatgggtcacagtcaaaagttggtttcaccaggtacagtagcttgagcctgtattaccagctactcaggaggctgaggtgggaggattgcttgagtgcaggagctgagactgcagtgcactttgatcatacctgagaatagccacagcacttcaacctgggcaatatagtgagaccctgtctttacaaaacaaataaaaccaaaccaaaacaaaaaacttggttccatgcacaaaagtatttaaaatgtataaaactaccttcaggctatgtgtataaggtatatatgaaacataaaaggctcatatttaaacctgggtctgatccccaagatgtatcattatgtatatacaaatattccaaacttcaaaaaaatccaaaacacttcttctggtaccaggtatttcagataagcgatacctgacctgtatgcaaatagaattgtagtggtagatgtctatctgattattcttccagatgaactttataaagatataagaatcactaaagataaaaacatgttatatgtatgtgtatgtatgagaagagatgtatatgactctaatctagatatagacctaccagtggaacacaacagagagactagaaatagattttgaattcagatcagtagagaaagaatgggttagttagtaactattctttaaataattgactaatttgattacttaaaatcaaattattacataagaaaacataccatgaaaaataatttggaagaaatatctgaaacgtatcacagaccagatatccttaaatttaaagaacacttttaaattataagaaaggaataaatattctaaaagaaaaatgggcaaagaattttatcaggcagttccctaaagtaactgaaatacataacatattaatgaggatatggccaacctcactgataacaaagaagaagaaattaaaatgataggtgaaaaatacatttggctgtcagaaaatttaaagattggtaatacacatttagtatagtttgggtatggtaaaatgactattctcatgagttcgttgtgagtataaattaggtaaaacctgtttggatgaaagtctgtgaatatgtatcaaaagcctttaagaaagtatataacatgtgacaagcaattttgcttttaggaacttatctgaggaaataagtgtacaaatgtgaagtcgtgtgtacagggaaatttgtactggctttattacataactgtgcataaactgagggacagagaaataaattatattccatttgcagcttttgaaaagaatggattaggtcagtgtgtatctttattgaaagatagctgccgtacagtgaaaaaaaagttttattttttttttccaggaaaaagccagtcgtaatgtataatgtttatgtgtctctttggtgtgtgtatactagaaaagtgtctccaaaattaaatgtcatagctaacagtaactgcctcatggggcaggatgagtatacttgtacttctgttttttacactgatatatttgtattttagataacttggatcagagaattaatcagaaaattaatgttaaatccacatttgatagttttgccttgatttgtttggtttaattcagaatcgggataacattttctacatttagccggtctgaaaattaattttctttgtgaagattagatcatggttgaaaaactaaaagcaaattgaatattgtggaaatacttattttaaaaattattttttattattaattttgacaaattgatgacttggtaattaaaagcaaagagatcttttctatttgtatgagcccttcaccgtgaacgatttgtaaatctgtttcatgttatgttttgtcatttgtcatggtgaataagttgtactgttttgtatgtcaaggcctcggtttatgtttaagttcattttgttgctgaatatgccctgtagaatcatggtgtgaaaatgaatattgaatcaaatacataaatattttaatgtaatgtgattactatattatattggttatattatgtatgataattcttgaagtcattttatccattgtctcaatagaatgtatctgacatacactactttcgttttcttacaggtgaatggaactctggtgactcattcaaatcatctggaggtggtgaagctaatcaaatgtaggtgaatgttattcttagttttaattgttttctgaaacccttaaagtaaggagcagcaaatttcctgtaataggccaaatagtaaatatttaggctatgtggactatatagtctactgccgactctgtcattgtatcatgaaagcagccatagactatatgtaaatgaatgggtgtggctgagcttcagtaaaactttatttgccaaaagtctgtgatcctggtttagccccttggctggagtttgctgatccctgcattgaaggaaaatctgaggtgaaaactcttagcttactaatagctatcttttgtcaactccatttatatggttgattataatattcctgtcattcttggtaatatttgatacatatatttgaaagaaatgcatgagtcacctgagaggaaggaggttgagaagtcagacatatggcctgatgaactgaaatggaactttaaaaatcatctagcacaatcactttccctcagataagtaaatgattatataatccagagtagcgatcttctcttggaaatctttagggttaagaatttgtgatcttcaggtttgagtgaatagcccacttggacttagttctctgtggagaaacaggcttgaagcagtgggagtctgcagctaacctcccgtcacttgcagggtcaaaggtggattcacgaacctcgagctggcagtgagttatgggcaagccaggcctcagccactcacagggcctcagttttcccatctgcacagggagaagggaaggttcagtggccctgtgagctttgctagcaggtggtgatggggtgggtcatctgaatctgagtcaggtggaatcttccccaacctgggctttggtttcattttgttgttatcctttaaccttacctgctttccaagagagattttatgttttcttggttttttttttttttttgtttgtttgtttttagggtagggtcttgtagaatgcaatggtgcaattatagctcactacagcctccaacttctgggttcaagtgatcctcccaccttgttttttgttttttgttttgtcttgtttttttggtagagacagggttttgctgtgttccccaggctgctgtcaaactcctgggctcacccatctcagcctcctaaagcgctgggattacaggcacgagccactatacctggccaagattttatattttctaattgcttcacatactgaatggaaaatagcatgacagttataacagaagtaaagaaagtcacatgagagtccaccacctaaaatataacttcctttttctttgttctggcctggtttgggccgtatgtatttgttattgtatctcttaaaaaaaaaaaaaaaaagagagagactgcttgaactgaatgaaatttttttaaaaaaggaattaaaaaaagaatttatgatcttctgcatcagattattccacagtaaagtagactagaaataagagatagttgtttgtgatcaatcagaatcactactgttttatttaattctgtttctctgtattgggtggatggacatcttcaaaagaaatttaataaactaacttttttcttggcctttttactgctatgttaagcaactatgaaattttttaaactttttcatcagagtaccagtgctccaaatggtcactttgatcagcgttctttagtttaaaagagtgcagtgatcaaaattagatccccatacttgaataaacttgaccacttatttaatgagaatgtgatttataaattgttatgtgctgcataaatatggtttatgttaatgagtttatgcctgatgtccattgaggtgtataaaaacatttctttagctttctaggttatattttttgctcattccagtataaattttacttaaaaaattaaatcctgggattctagcaataaattacttacccaatagtaagggcatagctaaaaacttaaagtaaagcataaaaacctctgcatatccaaaactgatgtaaatttgacatcacatctgtaaagcctgggtgtatgtaacagagttcctgcatgtcctactttctaatgtgtattctggatataataaaagtgatatcaaatcagagcagtttagaaacagctaaagaaaggaagggaaaagctaggaagctattaaaaccaaatacataggcaagtgagatataatagatgactttctgatagagagcaataagattgaagagccttagaaagtgtttatatgtaaaattcctccaaattataacacttgtgagtattatacatagcaaaactagtttttagaacaccaaaacactgtgaaataattgataatgatttccatgggagggttaaattgggagacaagtgtgaaatacatttaaaagttctattgaaatatctaagaaaaaagttttgccatatctattactgactctgattatggtgtttttttttgtttttgtttttgtttttgttttttgagacgaattcttgttctgtcacccaggctggcgtgcagtggcgcaatctcggctcactgcaacctccgcctcccaggttcaagtgattctcctgcctcagcttccctagtagctgagactacaggcatgtgccaccacgcccggctaattttttgtatttttagtagagactgggtttcaccatgttagcaaggctggtcttgatctcctgaacttgtgatctgcctgcctcagcctcccaaagtgctgagattacaggcatgagccaccatgcctggcctgattatggtgatttttgctgtctagattcccgccccccgcaatatgtctactgaattcctgtccattcctccaaatattttctactaaaatttactacttattattgattgtgtttttccctgttattgtggaatattttttggtcatactcattttgtaaagttaatttaaaattgcattttatgttctagcatattcactaaaccctgcctagttagtgtcatcttaaaatatgaagatctaggccaggtgctgtgtctcacacctctaatcctagcaccttgggaggccaaggcgggtggatcgcttgagctcaggagtttaagaccagcctgggcaacatggcgaaaccctatctttaaaaaaaaaaaacattgcagctacttgtgggggctgaggagggaggattgcttgaacccaggaagtcgaggctgcagtgagctgagatcgtgccgcggcactccagcctgggtgacaaagtgagaccctaattaaaaaaaaaaaagaagatttaaaaaatttacatttaagaaattaattaaacatagccactaatagatggttgattttaacactcctctaaataaagaaaatatataatatattcttggagttataaattttatttgcttttaagtaatatctgatcttactagtagtaacttgctatctgaaaacggcatcattcttttggatttttagggcagtcataaaagagaaatgacaaattagtttttttttctgtggagacatgatgtagcagatgatgggactgtcttacataactggatcttttagaactatcgaagattaagtagtaaaatggtataaaaagtttcttgacaatgttattttcccttcccttccctttttccgtctccccaccccaagctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggtaagaatggggaaatttcttagttaaatgctcagtcttataaggatgtgtttactttatatggagagttttcaagtattcggctgatgaactaattaaatttaagattttagaaaatgatttactaatataaaaattacataataggaatgattagaatattgtcatagcagatttaatttaacaagtattagacacctgccatatgtaaaacagtgtgccacccacagaaatatagttaaggtactctatgttcaagattatagtcatcttagaatgtgtacttttaggagggcggggatttttgtttattttgtttactgttacgtttccagtacctgaaatattgcttagcatgtagaaggtgcttaacaaagctttgttgattgagattaagtcaagagtatacaagtaactataatacaaggcagaatgtagacattatgagggcaaaaaaaatgctaagttctatgaggattcaaaggagggagaaagcacatagaagaagaacaataaatagaaggagccaaaaaagcatcaaatattgtggagaagtagctaggatttttggttggttggtgcctgttaaggatgtgcatagtgggagatgaacttgaaaatagtaggttgactatatattttgaaaagtcacatctcccaagctaatttacatgtaactagataagcagtaagaatccattcaatgttgtttctttttaagcaaaagagtacatgattatcctaggattataggaagactaatttggtaaaatattatagggttgtgaaacaaggagggatgatgggtgatgaattagggagctgtcttcatatttcaggtaagaggtactgggagtttgagctatgcatggggatcgatagtaaagatccaaatgagggaaagtaaaagatactattcttatactaagacaacttcatttctccaatatcaatatttagtgttctcttgaatccagtttagtaaaaatgaaatagaagggcagacatttccttgtagtttcttgtaagtgtcatgtctgaaagcctgtccacataacccggaagtaaaaacctaataggtattgataattggagccgaggcagaactttgtatgccacattttctctatttattttagcttcattttgtctatactggttgttgtttgttttttatctttttcttttctaggaggaaaacaatgtggttcataaccagaaagtagaaattctgagaaaaatgttacagaaagaacaggaacggctacaggtattaaatgagaagtagggctgtttacaggccaataaaaatgtgagtgggcatggttgagttggtgtttatcagtcacaatcaagcagcattgtaaccaatgccattagttatattattgattaagaatggactatttctgtatcttttttacataagtaattaattctgaaaatatttttataacttttcagttattgcaggaagattacaaccgaacacctgcccaaagattgctaaaagagatccaagaggccaagaaacacattcctcagctgcaagagcagttatccaaagccacaggctctgctcaggtagcatcactattacaagtgctacccaactttttgcaggagaattttcttctgggaatgtgtcagagaatgttgcagttgccttttttaaagttatttttctagcgtaggacaacaggatgtcctgttaaggatgttacagaagtaatgattaacaaaaataaatgtgggcgtctgattgtttgcttgctcatgagatcacatttctttgttccataataatttaaaaaagaattgagtgcttttgctttgatgtgacaaactactaaaatgtatttagatatatatatatatttatattttttgtggttcattctgccatcttaaaacagaatggcagttgatatgtttttaaataggaatttaagaatttacaacaacaggcattgagctaaatatatggacaagcattttcttatttaatctgcataacatctctgaggttacttatggttgttttcctccagtttacatatatacttagagagagttagagagattaaatgacttgtctgaggtcatatagctgcaaagtaatagaactggaattcaaacccagtctgaggatttaaaagcacattcatactcttaatgactatatttttattgtaatttaaaaatagatttcagtagaatttgctgtatagttataagctatagagataatggtctcataagaaaaaaaaagctcagcatttatatgttaaccagacttacattctgtaatattcagatttgggatatgtaaagcaccttgtacttcatcttaaagcaaagtagataaattgcctatacatttaaaataggtaaaagctgtttttttgtcactgttcccgagttaaatctgaagggaaggctgcatattcgcaaaagaattctttgagatcatctagcctaatctgcttactttctgatttaaaaaaattatgttataattgagaaacctagggtctaaactggttaaatcacctatacaaggccatacagtatgtaaggtcccctgacatcctggtttagtgtacttttcattccattgtttttttcattaccttcagtcccagtagcgatgtcacattttgagtgttacacctcagtaatgttgacagttttatgttattactaggcaaatataatattcttaccctgtttggacagcaatctaaatgcttataacctggccaggcgcagtggctcacacctgtaatcccagcactttgggaggccgaggcgggcagatcatctgaggtcgggagtttgagaccatcctggccaacatggtgaaactccgactctactaaaaataaaaaaattagacaagcttggtggtgcatgcctgtaatcccagctactcgggaggctgaggcaggagaatggcttgaaccatggaggcggaggttacagtgagccgagatcctgccactacactccagcctgggtgacagagcaagactccatctcaaattaaataaataaataaatgcttataacctgatctaaatgcttataataatttatgttatagtattatgtcctagaattggccattgattgacactctgaagcattggaaggtagttaacaagaaactatagggtaataacctttattaatgggcagacaatataaattatataaatataaattacataaattaacaaaccattttatctttttgctatatttagaagtttgaacttacattctttttaccaaaatatcacttgccctgtctttaaggtcatgacattttagaataccggaattagtagttatttatggattttactcgtagaattttaaacatacttgagcatatcagaatgtccaacttttagtagtctccatgtagattgtagtaccactatttctttatgcagcaagtaatgaaagttttcttttatgtgtttgtgtgcgcgtgtttttctttcatctgttttaggatggagctgtagttacaccctccagacctttaggggacaccctaacagtcagtgaggcagaaacagatcctggagatgtactgggcaggactgactgtagcagtggagatgcttctcggcccagtagtgacaatgcagatgtaagctttcagttttctaaatcttttttcttctgtattcttctttacagcccctttctagatttgattttaagtgatgtgaattagaggtgtcttagcactttttaccatccccatttttaatgtaccaatttgataaacagaaatctggttactgttatatataagcttttaattccagagttcactttttcccttgaacacccattgccaactgtttcttttacagggatggaatttcccagcaggcatcttgttcgtgggtagagaagttactaatgccagtgcatttttactgaaccgagagaccaactgttgatatctttaagagcatgttaatattccatttgtggtcagagtgactcagtcttgaatcatggggcactttgccattaccaagaggaaaaacctcagtcctgttagataggcttcagttaatagcccaggtttagtgacagcactttcttgattaacccagaaactgccagatgaacatgactatctgttaagatgataataaaacattttaagctgaatatgatgtaacaccatagacatatgaatacctaaaagctaagttcagtattacttacccagcaatactttgtaaattgtatgcagtggtaggaataatgacttaaatgtagatcaccctctttaaaagtgatgagggaagaagtctgaacgaatgttttgtaattgtgggtcatgaaatcaattttgtgggttgtatttcttttttaaaaaaagaataggaaatacagtgctttgcatatagaagaggtgtcacttcttgggacttttgttacatatacacacatctactatttaacaatgtgaagtttctctcttattgaaggttgttgttgggggattgttttgttttgttgttttttaaaaaggaagccgtggtctaagccatcattcaggctatctcttgaggcttaggcccaatgacccagttcctcatgcaaaaaacaaactgaggatttgtgggttttttgttttgttttgttttgttttttaaggtagtgataggagtcttgtgattgggttagctaaaggttttaatggaaaatttcaatttgggctcaaggaaaaaatggtagtcactaatatttgttgggtatatgtcccatacacggtgataaggttttatgttccttagttaattctcaaaacagccttatgaagtagtactgttgttactgtaactttacaaaagaaaaaattgaggccaaagggagttaactaactttccaaacttattcaggcaataggtgatctacttccacctagctccaaaataccagtaatcgaaatataaacaaaagcactgaggtttgaaaatgcgtaacattttgagagagcagtgagaattttagggcaacctggcatattagggttatagatggaatggctagagattatcttagaagccaaatcatgaatccaggttataaagggcttcaacttgttctagcagtacataccgcttttgggaatgcttttcgtactcttctttttgttttagtaatgcgtctcctcgctgttttcatggcttgtccctaccatgagatgggaagttccttgagagcagagggactgtcttgtctgactttatgtttccaaagtgtagcaaattgtaggcattcagagcaaatgatacgaatgagaaatttgaattttatcttgtatttagaggaatgttacaataaaacatgtgacttagaaatataaccttataaaagagtgaattgttggctgggcgccgtggatcacgcctgtaatcccagcactttgggaggccaaggcaggccagtcacaaggtcaggagttcaaaaccagcctggccaacatagtgaaaccccgtctctactaaaaatacaaaaaaaaattaactgggtgtggtggcacacgcctgtaatctcagctactgcagagtctgaggcaggagaactgcttgaaccagggaggcggaggttgcagtgagccaagatcgcgccattgcactccagcatgggtgacagagcaagactccatctcaggggtgggtaaaaaaaaaagagtgaattgtttagtatagaaataggcattccaatcaattaagactgtttgacatgtaattgatacttagtatttgaatacatgaaatcaatgaataaagtgggctttatcttgcatgcagaagagagacaccatcagaaacatatctgtggaaaatgatttggtgtaaagagggagatctgtaagaaaagaagactgcttggcttaataggaactttaacaaatgtgtgctgaatggataatagttagcatttattcagtacctactttgtgccagaggttgtacccaatgctttacagatactcttttttaacactcataataatcttaaaaaagcagtatcaccatttcatagatgaggaaactgaggccaaataaataaatgaatattgtggaaatccgagtgagaaatgataaagtccaagctaggctatcttctgaacacagaacacacaggtttaatttctacaagtgtctgaggctaaagatgtgttgcttttagcttatggatttccatgtttgtttcaattttaagtatggaggacccggtctgcttttgttgttgttttaacagtactttgagtcgcggttttacattttatcttttgaatcagtgcttttaacttttttcattgtcttctcatttttataaaataatttcctggtggtgtttgtgaaagttccctgcttttgcttaccttggagaaggctttaaagaatgccctgatacccagttctcacaagagaagcaacttggtaacaaatcatcatctgaaattcagagcatctatcattttgattttcagtttgtgagtgatatttttgaaaaattatttattttggaaaattgttaaacatattcaaaagtaaagactaacataatcctcctcatgtccctgagaacctagtctcagcagttttgtttgtaccccctattcctcacatcctccaaacaccagattaaagtaaatccaaggcattcgtttattaatatgtctctctctaagagataagaagtttttaaaatatagctataatattcttattaaatcctaagaattaatattttctcaatacacaattttattaccttgttttataatgatctttttacagtttatttgattcaggatccagtcaaggctttcatattgccattggttaataagtcattttaagtctttataatttataatagtttccttcttttttttccttggccatttgttgttgtggttgttgttaaagaaattgagtcagatgttcagtaaaacaatccattttctaattatattttcatggtgtcgtatgacatgttcctttatctaaattttcttaaaactcctagttaaatctacaagtcttgatcacattaggtttgatagttgttatttggaataattcatagatgatactatgtacatctcattatatcacatgaggatgtgaatggctgtcttactgtggttgtaagcttaaggtgtttaggtgatatcaacatgatttccttcattataacgtcccctgtcaagcttttttttttttttttttttgagatggagtctcgctctgttgcccaggctggagtgcagtgacgcaatctcagctcactgcaacctccgcctcccgggttcgtgccattctcctgcctcagccttccgagtagctgggactacaggtgtctgctaccatgcccggctaattttttttgtatttttaatagagacagggtttcaccgtgttagccaggatggtctcgatctcctgacctcgtgatccacccgcctcagcctcccaaagtgctgggattacaggtgtgatccaccactcccggcccccaagcttttgtgaaatgttttcacatgccatttatgatcaaaatgcctagatccattgtttaattcagagtttcaaaaggatattattataattttgtcagtatttctgtatttattacatggagttatgttacaaaaaatgatttcccttactagctaataggttaccctaaaatacagcttatacagaaaatgtagggtaaatacttctcttgattcttttcagaagagttttttcaggagagatgatactcttacaaactccaaaggtgacaagtgggaagggtatatgtgtgtaatattttgaactcatagatttcagtatgagttactcttttcttttgttggtgggagccccctcaaattttctcctgtgttcttttgacatgcccctccaatatctttgatagctttcttgctttttgtgacagaattattctaatcttttatatatcttgtccaagacctgaaagtcattcatttctccaaggtggggcatacatttgaaagtgctgttttctcttggtaacagaaatatctgtgataccaccaagatatcttgctatatgcataggtaaaatgtatcttccctattggcactcgttaggtctctggttcctcattttcattgctctaaagaatgtctcccgttgctttggggtgttcctcatctccacaaagtgagtttctgtgtctcatatagttcatattttatacagaagttctcagtatttgtggacagcatctgtggattcagccaaccatttatcaaaatattcagggatagaaatgcatctgtactgaatatgcacagacttttttcctagtcattatcccctagacaatacagtataacaactatttatacagcatttatgctgtattaggtattataagtaatctagagatgatttaaaatatatagaagatttgcgtatgcaaatactataccattttatatcagggacttgagcatccattcccccacaaacactgaagaacaactgtattaggtattatacaataccatataaatgtattaaaatccacctttcacatgaagcgagtaacagaatagtagaagcttaattgtactcataagtagggcaaaatgcttttagcttggatagaaaggatagtttgagaaggtaaggattaaggaagataagagagtttgattttgacataatgagtttgaggtatgcagtatatctaattatttggtagaaaagtaacctccaggcctggagattaggtaaaattgttttgttgattctgtattgtttatcaatataaaattgaaaaggtgagagaataagtgacttgccaaagtaaggaaaaagtagcagaaccaagcattttacgaaagatatttagtagttgtaaatacaaatatgaaattcagaacaatttttttttcacacttttttccctcatctccttttggtgtgcctattgaaatgaactgaagatcttgtttttttcattagagtcccaagagtggcccaaaagagagaatttatctagaggaaaacccagagaaaagtgaaacaattcaggacactgtgagtatgaaatccatgcaatgatagtgctgtctttggctttccttatacttaaagtatggtatagacacatctgatgtttacatattttattttttattttttggaaaaaaaattaaaatttattaaagaaacttaataaagatttgaataagtcaagagatattccatggtttgtaagtattcttaggttccttcatatttgtcgtggtggtaacataaaatgtactagtttaaccatttttaagtgtatagtggcattaagtatattcacattgttgtgcgaccatcactgccaaccatcttctccaactgcaatttggtacccggtaaacactaagtctacatttcccccttccccctagcccctggcagccaccattctactttctgtctctatgaatttgactactttagatactcatgtaaaaagaatgatacaatgtttatccgttcatgactggcttctctcacttagcatatgtcttcagctttcatccgtgttgtagcatgtgtcagaatttccgtcctttttgagaccaaataatattccatgacatgtatatacaccacattttgtttatctgtccgtttgtcagtgggtacttagattgcttccactttttgctattgtgaatatgctgccttgccttcagtttttgtgggtgttcatcaagaagaagaattgtttgatcttacgtattcttaattgcatgcttttaagcactctgattttatcttctaattacatttatttacagttttgtagtaaaagatacaacagcattttgtcatctttttattgttagcaacataaggactattgaaaaatcagagacatcaaatcagttataaaatcaaaattgtctgactactgctcgaaactaatttatgttgtttcacctaatttcttttttttaattttttaatttttcctttttttaaagagggagtttcgccatgttggccaggctgttctcaaactcctgacctcaggtgatccacccgcctcagcctcccaaagtgctgggattataggcatgagccacagtgcccggccagtttcacctgatttttttttggaatattaaagccttgaggttaaagaaaataataagagttgttaaaaggcagaattgtgtttaggagactcaatatgtagtgttgcaacactaggaggaaaaactacaggtacatattattcactcagtttaaaacttgcggatctgtttatacaacttcagctatagccactataactgctgtgcaaatgactctcaaatcataggcctacccttctttgctgaactccatccagatcttgcaatgttaaactgctgttagatttaagccaaactcatttttttcctatttcttccaaaatttttattccccaatcctatatggtctttaattttagtacttatggtcttcagacatcctgtatgtatgtatgtatttatgtatgcatgtatttatgtatgtatatatgtatgaatgagacagagtcttactctgttgcccaagctgcagtacagaggttaactgtaacctcaaactcctgggctcaaactgtgtacccactttggcctcccaagtagctaagactatagacacacgccaccacgcctggctaatttattttggtttttttagagatgggtcttgttgtttttcccaggctggtttcaaactcctggcctcaagtgatcctccctccttgacctcccaaagtgctgcgattacaggcctgagctaccgtgcccagcacccatgtttattattttatatattaatgcctctgtactgccgtttttgtgctgaatctaactttgtgagttgacaaatggaggagctattgcatgggaaactatctgacaatctacaatttattcttagaattttgttatctttgtttctatagcagtgtttgtgagattacttgatgattttagagcattgtatcagtgatttttcaatcaagagtgattatgcctccgtggacatttgacaaatgtctggaaacgctgcagctggcatctggtgggtgcatagaggtcaggggtgctgctaagtgtcttagaatgcacgggctagaccctacagccaagaactctctggcgcaaaatgtcaacagtgccgcagttgagaaaccctgcattatacatttatgaaaattaattaaaaatgaaaacatagagttcgatgatagccttcaattatgtatcattaatggaaatcttgggttagtacttctcaggtatattagcctctctgctaactttgtcttaccatttctgctcttatttttcctttctcctattgtcttcattcactttttctttaattttttaattgtaaccatttatgtaagccaactttatttttttctgtaagaagttttaagtatgtatgaattaataaaagaatgtacagaagtgtacagaaagtgttaaagtcagataaccaagtgtatagtgagcaaaggatatttactgtttccaaggggagtggttttttccccccaaaaaaaactcgttgttgtggtctttttctctgccagagtggtacatggccttgaaaatttgtgaacccctactttgaaaataaagtacttcaaaggaaataaacaaaaagaaatctcaccatttaagtgaaccatgtctttttgatgggttggctttattctttttctaaatttgaccaccaggtaatttttctgtttcttttccctgaatgttgccaggacactcaatcacttgtcggaagtccctcaacccgtatagcacctcatattattggagcagaagatgatgattttggtactgaacatgaacaggtgatgacttttttctttctaaaaaatagattgttactttctgcaatatctgatttgttgcaaaaatgagcacgttctggagattaagataacatttgtaaggatttgaagctaaatcttagaaccaatagctccttgggttaattgcttattttagctttgaccaacagaaatgaccttgcttttaaagccagtgagagatcattaatatatgtttaagtacttcattttattggggttgagtgtgtttcttaaaatagtatttttaaaaaaaatttcaaatcccagttcattggtgctataaaggaatatgattagctagattcttgtccttgtatcctgtgatcttgctaaattcacttattatttcttggtgcttttaaaaataagtcttttggagttttctacatagataaatatgttgtctatagtttttatttccttattttcaagctgtttatcttttatttcttgttcttgcctttattgcactggctaggacttccactatgaggttgaatcagagtgacaagacatgcttgccttattcctgctattagggagaaaacactcagtctttcatcattaagtatgatgttagctataagtattttttagaggctctttataaggttaagggttattaggttaaggaatactcctggtttgctgagagtttttatcatcactggatgttgaattttgtggaatgagattattatgtggtttttctgattgtctattaatatggtaagttatgttgattgatattagaatattaaactagtctcgcattcctggaatgaacctcagttggtcatgatatgttatcccttttatatattgtcggtttcaatttgccatattttactgaggattttttacatctttgttgatgaaggatattggtgtgttgtttttctttttgtaatacctttgtctggtttgatagttgggggtaatgctggtctttagaatgatttgggaatatgaaaattgtgatgctagtttacattattattgttttctgtgttcagtatatttagggattatacaaatattctaggatttgtcttacttaaaatcatacaacttcatttcccaccatttctgcaattagcccagaagaaaaggataaacagctattttatgattgggcaaaaagccttccactgcatttctagaaatgttagactgttttttacatactgatttgtatacatccgagctacttgataatcgtctcctaaatttccgttctcccacagtggtctttcttctaacctatccccaagaggtggttaatgttcacagaaagagattccatagcttctgttgctaataaattttagtgaagttttttaaatcttgaattttttatagggagatcaaagtgaaatttggatagctatgttcaattgagcctactttgcatttagtatttgtatgttggagttactgatgcataatcatttcttcctctagatcaatggacagtgcagctgtttccagagcattgaattactaaaatctcgcccggctcatttggctgttttcttacaccatgtagtttcacaatttgaccctgcgactttggtaatatattttacaatctagcagattcagagttcttctgttgattcatgtgccatagaacttttcctagctatacaacgagtgggcagacttctttcagttttccgtataaagacagatacaaaagataattaaaacattatttttaaagacttggttatatagtaataactacattgtttatggtgacctacctgttccagacattcctactcaatggtgacctagcaaattacatttttcatggttcctcattttgtctttttcattcctttctccactacagctctgttatctctattcagacctgtataaacataccaattccaaagaaactcgtcgcatcttccttgagtttcatcagttctttctagatcgatcagcagtaagttgccaagttaatgttgtaatctttgccttagtacatggaattattgtcctcctgcttcctatcttccctcccatgtttttggattttactgtgctttctcacacctgtattatatttcaattattgattactctagacttttttttttttatcatttctaaagtagtttaggcatatgaattctcacagtaggttttaggggattatatatatatatatacacacacacacacacacacacacacacatatatatacacacacacacacacacatatttgtgttttttgcatgtgcataattagagtgaggaaatgaaaaagggaatacatatatattaagacccaaggaataatacttgaataactgaactctgggtggcctctttgaagtttggaggcataattttaactaaaaagtggcagaaaagatttcacttacactgaaataaatgatgataacgttatattttgtcattaaaagtgttaataaggtttttaaagtagtaagttttattattagtcttgttatgggtaaatagcacctagcccttaatgcatactggataatcatgccgcaggtccctagtcctttcacatttgcagttcccttagacgactgcctcatgctttttccctcctaaaacctccatcacttcctttcctagtcctttctcagctgataaccttgaccttattgtttctctgagaaatttaaagtatatagaagagaacttctaccagatgtatcatctgccctcattataccataccatgtactctactctttctcctgatgctatggagtgactgtcttttttttttttttttttgagacagagtcttgctctgttgcccaggctggagcacagtggcacgattgcacctcactggaagctctgcctcctgggctcaagtgatcctcctgcctcagcctcccaagtagctgggactacaggtgtacaccatcatgcctggctaatttttgtattttgtagagccggggtttcgccatgttgcccaggctggtcttgaactcctaggctcaagcaatctgcctgcttcatcctctcaaagtgctgcgattacaggcatgagccaccgcacctggccttgattgtccatcttttatccaaggccagctctgctccagtttacagtgtatttccttatacctactcaaagatcttactctaacaattatcctcccttctcctgcatcatcggttttatattttctacagataatcattcacattagtctgcaaatgttgttattttccctttctaaaaacaaacacacattttggctctacttctccctccaactcctgccccgttttctttgtatgcctttacaaaattgtctgtacactttcacattcaattacctactcagtgactttcctaaccaacctacttaaaatctcaaccctttcactttgtcactttttctattatttttgtccatagaacttttatttagttagttagtttgtttacacagtcagtcttctgtgcctgcagcttccacgaattcaactaaccatggttgaaaatattcaaggaaaaaaacaaaagccaataccacaataaaaaatgaaacaattttttaaaaatatagtataacaactatttgcatagcgtttacattgtattaggtattataattaatctagagatttaaagtatacagcaagatgtgcataggttatatgcaaatacagtgccattttgtacaacggacttgagagttcgctgattttagtatccatgggggttcctagaaccggtaccccatgtggatatcaagggatgactatattcctactctcctaccctgaatataagttttattaggccagatatttttattctgtttgttcactgctgtgtccctaacactgaacagttcctgggacatagcggggtcacttaagtatgtgttaagtgaattagtgttctgatcctactcccattgtttaaaatattgtgttatttttattaaaataatttactttcctaaaaaaatgacaatatattgaagcatgtttgaattttgcatttcttaagagggcaccaagctaagtcaaaactttacattttgctacacatgatctatatatcaatattaaagtataagaagaatccttacactttgattaatttgctaattatacttttatgctacagctcacatttatttcatatatacaccatcatacagaaatgagcttttattacttttttgcacttgagctagaaatgcttttaagaaagttgatttgagctactgcctgtcaaagagaaagttttaaaatccattttacttttcttcaaatgaatataaagagatcttacaatttttagcggtgacttattttcaaatttaaaacttcagatcttataggatgtgtttaaattctgaaattgtatgacttaaataggtatacaatacaaaataagcaggaagaggttaagatattttctcttaatgcaaaataataaagtattcccctccattagtttgggggtgggggaaaacaacagactggtaattattatgcaaatattatggggaaaatcctagctaggaataagtaaattctaagatagtcaccttatttggttcagtagcaagaactgtagatggttgctggagatttaaaactccaaaaactcaacattgacattcaatattttctcactgggagtgtgacattgtgagggctcttaaactttacataggaaaacgattaggaatattattggtcttcagaatgagcatctcaaatataggaaagaaaaatcatggctatatgtgagtacatttttcatatgataatatacacataatttaggttttacctatattgatctaaatgacatataactgattatattgaccaatgattctaggaagccaaagccaaagccagtatattcattaagtgtgtcacagaagcattcagtcatctagctaaacgactgtagacttttcctttatagcatgatcctcgggaaaagggctcattttcaagtttaaacgatagaatgttctggagttgtgaaatgtgaatgaataaatgagcttgtacttgattgtgcttgtagagtgggtatccaagttgtatccccttactttacagaagtacttatgtacatcttcaaatatctttagcgttgttacaccttttgtttgcatttcattttagcacctgaaagtttctgttcctgatgaaatgtctgcagatctaggtaagcttggagcactaacatcctggagaattacatcttaatagatatgtagctcagctcatctgttcaggttttatctgtcacatggtgactagtcgatcacctgaatcacaacagaaagacagtctataatacatttaaagagtaaatgaggccgggcgtagtggctcacgcctgtaatcccagcactttggaaggccaaggtgggtggattacctgaggtcaagagttcgagaccagccttgccaacatggtggaaccctgtttctactgaaaatacaaaaatgagctggcatgatggtgcatgcctgtaatcccagctacttaggaggctgaggcaggagaattgcttgaacacaggaggcggaggttgcagtgagctgagattatgccattaacactccagcctgggtgataagagcaaaactctgtctcaaaaaaaataataatatggctgggcgcagtggctcacgcctgtagtactcccagcactttgggaggccgaggcgggtggatcacgaggtcaggagatcgaccatcctggctaacacagtgaaaccttgtctctactaaaaaacaaaaaagtagctgggcgtggtggcgggcgcctgttgtctcagctactcaggaggctgaggcaggagaatggcatgaaccccggaggtggagcttgcagtgagctgagatcgcgccactgcactccagcctgggcaacagagcaagactccatctcaaataataataataataataataataataataataataatagagtaaatgaaatcagaattctgggatgaaatatacgaactgccctgaagaacttccctctggcatattctaagttaatttgtacgaagtagcattgctatgttgccaattgtatgttgcccagaacatacctttagataacataattcctttcatttatgaagaaaagagaagacctgagctcattcctgaggatctgcatcgccactatatccaaactatgcaagaaagagtccatccagaagttcaaaggcacttagaagattttcggtaagcttagtggtagatagaatttcatatgattattctaaattaatttttttagttaagaaaaagttgctcattaaatacttagcttagcactagataaaccatatggtcttattgttattaaaacataatgaacatctggagccaaagggttagagtggaactgagagtccagactctccattccaggcacttgcaggatctgagctcagtgctgtgtctatgctaagtgtgttcctttaagatattgtatgtgttcttggagtcattgcttctagaattttttcctctggtatcctagatgacatggacccataagtggaaaagtgacatttttcctgttcctagaaaccatagctgtgaagactgtgatgaagcgtccccagaatgaggtagtttttctttaggctacctcaggaaacttctctattcccttcaggcagaaacgtagtatgggactgaccttggctgaaagcgagctgactaaacttgatgcagagcgagacaaggaccgattgactttggagaaggagcggacatgtgcagaacagattgttgccaaaattgaagaagtattgtaagtaatagaagtatatgtggaaatgccctctctgctgagatactagttatgcttgaagtgtcctttgggtaggtttagaaaaactgtcagattgtgtatgtggagccgtttattttgtcatagtacttgagaaactggattttttttttcttttttctgatacttttagataaatttcttgtgttcctttttctgggtggtggtaaatgggtaactctaaaacttctaatcagtgatcaaaaacaggttgattactttcattattttcaatttataggccttggaaatatttcttgccatgaagcatatacagttggtgacatgagggtgaaacagataaggttctttaggggatcagggttcttttggtattttattctagggtgtggcccaaagcatttggctctgttctgttatttcaggtatctgagttaataacaatttttaaggccaggcatggtggcgcactcctgtaatcccagcactttgggaggccgagcgggcggattacgtaaggccaagagttcgagaccaagctggccaacatggtgaaaccccatctctactaaaaaccccaaaattagccaggcatggtggcactcctgtaatcccagctactcagaaggctgaggcacgagaatcacttgcgcccaggaggcggaggttgcagtgagccaggatcatgccattgcactccagcctgggtggcagagtgagactctgtctcaaaaaaattaattaaacttccatatttcatttttaaatttttttttcttttttttaaggatgactgctcaggctgtagaggaagataagaggtaacataactgttttttttcccctagaattttaagaaaaaaagaactatgtttttttcctttcagtcctaaattacaatttatttcttttaacttacaaatacagtttgtggtctctctctggtggcttgtatgttatttgactaatattctactgttgtcctgagtagaattctcttctctgtgcaatgactagttagttctttagtgtttgtttgatttatttcaataattccaaccttggggttttggaaatcatttgatgtctttattctaccaaccctcccttctcagaagtcttaatttacttcgtcctttctcctccagctccaccatgcagtatgttattctcatgtatatgaagcatttgggagtaaaagtgaaagagcctcgaaatttggagcacaaacggggtcggattggatttcttcccaaaatcaaggtaagaatgaaataatgtaatagcatgttcaggccttagggcttctttacatttggttgcagtgtcttccatcatcttagtatttacttaatcagcaaattaatgctagtcatacaaacatttataagatactgtctctgttctcaagaaactcaaaatacagtgagaaatccagacatataaactattattagacaatgtgaaaagtgaaattagcagtttacaaagagtgctatttctgattctgttcatgccttatactttccttttactttgcctaaactaaataccccctgtgttgctacataatcgtcatgaacatctttagtggcagtagagtattctgtcagtttgtaattatttgtgtttttgtttagtgtttactagattgtaaagctgtatgagtacaaggaccttctttattattgtattttcaactgttagcaaaatgcttagtaaatatttgttgaatggatgaatgaattgtttagaataagttcctggtaaatgtgctataaaactaccctttgattttccaaagctgtcagtgataaagagtttgaagaaaacatcttgagtttgaggtgtacacggtactgtgtgcgaacttttaattagtgctctgtgtgcatacacacgtgtacgggttttcatttacacttaacaatttctttgaactaaccattagcattacactatgaaaatcgcaaaagaaatttactctgttacgtatctcttattttttgtacttcaactctagcaaagtatgaagaaagataaagaaggggaagaaaaagggaagcgaagaggattccccagcatcctgggacccccacggagaccaagccgtcatgacaacagtgcaagtatgttgaagtttgaagtgctgcattttcagtactccaggccctcttcacatcagaggcttcttcagctagaatgaatttctggagaaaggagttgttaggatgattttactgaattcccaatatgccttgtttccattcagcgttatttctgaactaagtaccccctatgttgctacataattgtcataaacatctttcgtgggctgggcgtggtgattcacgcctgtaatcccagcagtttgggaggctgaggcaggcggatcacaagttcaggagatcgagaccatcctggctaacacaatgaagcctgtctctactaaaaataccaacaattagccaggcgtggtggcatgcgcctgtagtcccagctactcgggaggctgaggtaggagaattgcttgaacctgggaggcagaggttgtagtgagccgagattgcaccactgcactcaagcctgggtgacactggagcgagactctgcctcaataaaacaaaaagaaaagaaaaaaaaaaaacgaaaacacacatctttagtggcagtattctgtcaaatgtccgtaacatagtttacttacctcttctgattctgtttccattcaacttgtgtttgttaaattaaaaaaaaaaagtgtgtatagatctctccaccacactgaacgtctctttatacatatttacttagtctccatatttctaaaatttctccacctctccattgtactttattttctgatttccctttcaccccaggcccaataaagagagataagctcacttgagatggctgcaggagaaatagggatggtggtaccatggggaggggtcatgtgatggttcttatctcaggcagtagcacatttgaaaatactgaagccaggtgcggtgactcttgattgtaattccagcactttgcaaggccaaggcgggaggatcacttgagcctgggagttcgagaccagcctgagctacatagtgagaccctgcctctacaacaagaacagccaaaataagctgtgtatcatggtgcatgtgtgtagtctgagctacctgggaggctgaggtagtattgctttagtctggggagtccaggctgctgtgagccatcatctcgccactaaactccagcctgggtgacagagtgaaacactgtctcaaaaaaaaaaaaaaaaaaaaaaagatattggcatggtagagtggtgggagtaggattgtgatagtgagtgtcccccacaatgacgagttctccctcaaatgccatgagtgcctcttgttgagaaacattgagaaggtgtgaaatttttagaggaagttaaagagatggaggatttcacagatgctaaccgtgagttccaaggtatacaaaagaagaatttgaggaattaagagattagggtataaaaagttgtgtgagggtgtaggatgctttggatattgaacacctgagtgggagtctttggcttcttgtggtgactttgtgaacaaggataattagcaggatggggattggtctggatggtctttgaggtacattatgatgatgaaggtgtgagtgttgggggagaactggggtgggagcttactaagaactcacaaaaataaagacttcatcttcattcttacaaatgaacacagctccatgtctctcagcattcctcctccctctgtccaccattcctctccttcttttctcatgacccttcttctttccctacatcctcctcttcctcgctttcgtcgtcctgcctcacccctcctccatctcctcatctttctgctctaccttcctctccctttctctcttttcttcttccttccttcatctgtctgtctgtatgtttctctgcataacaatccactatatatattttttagggtctaccatgtttcacacattttaccagattcttttacattgtccttttttgcttttagctaatttgcaatgcagattattttatttattttatttatttatttttgagacggagtcttgctctgtcacccaggctggagtgcagtggcgcaatttcggctcactgcaacctccgcctcccgggttggagcgattctcctgcctcagccttccgagtagctgggattacaggcatgtgccaccacgcccagctaatttttgtatttttaatagagacggggtttcaccatattagccaggatggtctcgatctcctgacctcatgattcgcccaccttggcctcccaaagtgttgggattataggcttgagccaccgcacccagccgcaatacagattattaaccatcattttctgatcagttggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggtgagctattactgtagttcagcttaactaagcatcaagattttaaaacaaacacactaactgaaaaatagagtggcaagttaatcaagactaaatcccagtttaatttaattttgacattttaatatgctacaaccaataagaaatctatgccgaatgataacttaagttctcatttgtccaaaaaaatatttattaagctctctgtcaggcattagctttgtcccggatgttaacatgcaataattatacacagatgcttgcctcatgcagctttctctcttgagagcgatagtcacaaatgtaaaaaatgcaaattgtgccaagtccaatcaagggaaggtaaagggagtattgagggaactggtcagtagttagaggcagatgtgggtatctaaagaagactttttaaaaatctgagattaactagaggttttatttttcaatgttaataggaagccagctgaaagaaagggtagaatatgtgggagacagtatataagtagtagaacagagttgtgaggagagaggagatgagatgtagagtgtatgtaaagggtaagactatttactgagagtgagagttcagtgagaagagcaagggaatttgaagagtaaagaaagatatgaagcaatcgtaggtaattgggcaaggagcttattaccatgtcttcatccttgtttgggaggcggttcaatttctggtggtgacatgatcaagaatgaggctctgggagtggtccctgaggtgccatagaggaggctactagggatgaagacggcaaggaaccaagaagccaggagtttgaatagcttaatattcatggctagtgacgtcaccaagtgtgatttttatcatggagaggaaaactgtgagccaccagccaaaggtttagcattgctagatgattgatatgaggaggaagagaatgtgataatatccagagcatgagagcctcagtggagcaagagattatacaggaagacaaggtcgggtgcagtggctcatgcctgtaatcccagcactttgggaggctgaggcgggtggatcacctgagatcaggagttggagagcagcctggccaacatggtgaaacccggtctctactaaaaatacaaaaattggccaggcatggtgacatgcacccgtaatcccaggtcctcgggaggctgaggcaggagaattgcttgaatccaggaggtgggtggaggttgcagtgagccaagatcgtgccaatgcactccagcctgggcaacagagtgagactccatctcaaaaaacaaaaacaaaaacaaaaaaaaacgacaagataatggtccaaaaatcatattgaggaacaagaaggccattcatctcatctccaccctgacatacaccatataagacagaaatattagtttctgtctcagagggctgtagcagaagaggtaagctgctgggaataggcaggtttctacataaggccaagaagtacaagtgacatttggagaaaattctggggattttgtcaaatatggaactctgaagatgttagattgggtatatgcactgatatttcatggctcctgtgacttattaaaataaaaacatggtaggtggcggatgaacagaaaccataaagagaaagaaagtagaggaagggaatgtgttatcaggaaataagagattttaacaaatacttgggagattgaaagcagacaagagtgtaaagaagccaggcatggtggcttactcctgtaatcccagaactttgggaggctgaggcaggaggattgcttgagcctagaaattcaggaccagccagggcaacatgaaaagactgtctctacaaaaaatgaagaagtcagccagtcatatggcatgtgcctgtagtcctagctaatcaagaggctgaggtgggatgatcacttgatcctaggaagacaaggctgcagtgagccatgttcttgccaccgttaatgcagcctggatgacagaatgagaccctatctcaagaaaaacaacaacagagaaccacaagataaaaccataaaggaagccagagcccacaatttgtttaaacagtccaagatagaacccagtctgctcattggaaccctggagagactttgggctcagagttagcatatgttatgcagtgcaggaataagaaaaagagcaaaaatgatgaactaattgcaggtctataatcaaaatagttatatcagcagcttctaatccctgaattacagagtatgagcagtctctgtcacttgtagactagaagaaaaaaacagtgctcttttttaaaataattcagtgaattgtgtagggagagttaagtccctccgcagtattgatcgcttggagttctgacatttgggagtccaaagcctgacactaggcatgccggcaacccactgtgctcagagagctctcaactgaaacagacctattactatatagcagcaaaagaaagccaagtcagctactcactttcatcattaaacacgaacatcattactcacccttgtcagagtcaagacgtaagataatatataatgccaaacatatcagacaatgacataaagagagaatacagttaaacagaagaattttccctacaagagaaagataatctgataatagacaagaacttaagaaaatacttctaaattaggtagtatacttggggacattaaagaagttattatctctataaagcaagaatagggagcattcagagacaaaatatttttaatacaactattaaacacagtgacatctgttgtattatcaatttctgtgtgataaattaccccaaaacataatggcttaacacaaaaaaaatttatctcgactttttggtggatgaaggactccagagcagcttagctgcgtgggtctcggttggagtctgtcataaagttgcagtcaagatattagccagtcatcagaaagcttaactggggctggggaacccatttctgtgcccactcaggtggctgttggcaggaggccttagctcctcactcatggccttggctccttgccacatggacttttccatagagatacttgagtgttccatgaaatggtagctggcttttcccgagtatcccaaaaaagagagcgaaaaggaagccccaatgtcttttctgacttagtctctataggtgcactctgtcacttctgcaagttagaaacaagtcactaaatctagcccatactcagggagggaggaattaggctccacccctgaggggagaaatatcaaaaaatgtgtgggtatattttcagaccaccacagcgatcagagtttaaaggaaaaaaaagaagtccctaaaattaaagtcaaggaaatattttagagtgtacatcagaaatatgaaaggatagaaatttgagagaaaagaattatatagggaaccactacagagagccaacatctgtctctttcacaaaaagtcagctgaggacatggagaagagatggttaaacaacaggagaaagtttcccagagttgaaaaagaatacccatcttcaggtggaaagggctcactgagaaccatctatagtgaatgctttttaaaaaatccattcctaacatgtcctttgaaactgtagtgcaccagggataagctttcagaggaaaaaaaatggggattacactgcatcacattcctcatcataacactggatgctgaaatacaaaagagccatgccttcaactttctgaaggaaaatggttttgaacttagaatcctgtatccatccaagctattcatcaaatatgaagaatgaataaagacattttcagatacacaaggtccacagtttaactggaatgtacctttccctttgaaatcatttgaggatacacattctagcaacatgagaggaaaaattaagaaagaaaatgtcctgggatccaggaaacactggaaacacccaggaaagtggcaaagggcaattctaaaatgatggttgtgtaacaggccaggagagccactgctccagattggaacacaagaacatcacagataagaaaatggggattttaggcagtggatagtatgaagcagcagaggaaatagtttgagacttgatagaattatataactttgacagcaataaaagaaaagcatttagaaatgttaagaaaaacagaattgttcaggaaaataagtcatgatttaaacatgaagcaaaataaaaagtggcatgatctttagcaattgatggtgtgtaagaaagactttaataaatgttctatttgaagtggcccatggattgcatcattggaccggtaggaaaaaatatataatcctaactagtatatttcttaatctggcaggaatgatgtatatatgtatgtagtagacgacagtatatatatgtcataagcattctttcttggttttcagacttttagaataaccctaccaggcaagcatggagtagttcattatggctgcaggttagaatataaatgtaaaaaattcttttaatgatgcaagtaaaaatgtagttgaaagaaatggaaggtagaaggaaggaaatacaattagagggaggatgtggacactgaatacctaatctgacacagaagagagttgagatactaactttttgatagaacaaaaacatagacatgtcatttaaatttaggtagtaactaataacccagctagtaataatgataaaactattaaacattgggaagaaatggtagaaaagtgaaagtggaaagtgtaagtcaacaaaatcctcagaggggaaagaaatagatattaactaaagataataaatcatgaaaaagaggttatttgtagttggaccactgtaataactcacatttgaaaacatgaaaaaggattgatactgggagtagaaaaggataagatgggaaaatgttgttcctcatcatatactcttctgcactgtgtgagtccttgctatttcttacgttaatttttaagaaacagttttaaaaattatttttctgaccaggcatggtggctcacacctataatcctagcactttgggtggccaaggcgaaaggattgcttgagcccaggaattcaagactagcctgggcaaagtagcaaaaccctatctctacaaaaaaattaaaaatgagccaggtgtgtgtggtggcacgcaactgtaggccccgctacttggaaggctgagatggaaggatcatatgaggctgagatgggaggatcatgtgagcctgagatgccataattttgtatattaaatttttagttctagtgaacctgcagttgtttaaataagaatgtagctatggattaggctgaagctgttctgggaactaattttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatggtgagtgtaatcaatttgttgttgttgtttacaaatactgagttttgtcagagtgaattaagtctctcagccttggagtttgcttcaaagtttctcctagccttttgttttaaacaaagaggaaattaaactggacagataatccttgaactcaagaaaatgcaaatgtttctctgattcttattgataatttaaaaggaaaatgtgttaagccttaaagatatttaagattcatagcattatagatcttaaagttgaaaagtcattgcaacaactaagttatttttatgcatagattttaaatgaggaaggtaaagcccagggagattgaattcgttaagatcatacagctaataacgtgtaaggaaaaaaattcagttcctggtctttctgtatcgaagtgcagtgttctttatttaccctagcatgtatgtgataaatgtgtggcatgggtgctgtaccctttactatccttagcatgtgatatgaataaatatcttgtctctgacaatactgagacataatgaaattataagcctgaccccagaagtgagtgtttataggcaaattagataaccaaaagtactattatttcttaagagggctcaagttaaaggctatatgatgttggggcttacagttttcttaatgatgtagttgtgataggtgggtattattgtaaacagctggatgtgtttgggaatacactaaaaaaaatagttttgaatgatattttttatttgtcagtattcaactctcagagccagtatgtaggaaaatttcttggaatcagaatgacttcagagatatttcatcctttctaaatgataaataatttattatataattcatttgctacttcactccagctaaagactatgattgatcccatggaattgttctaagtaaggcaacatttcatatctctttcctgttcagaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatagtaagagaaattagctctgatctttgcccctaacatttccaatagagaaaagattgtgagtttaaaattttgtaaatgtacccatgttagtattcctgagattatgtgtgagaatgtaagataaataaaggaatgattggaactttgactagatccttttcctcacaatcaatctttcatgtacaatgtgtcaacatagggcttccagtctaaagtcattgcctaaggtgaaaaacatgaatagtcaaattcaccgttgaaaattttctatcaattatagtatatatatctctttaaatatatatatccaatataataatatacgtataaatgtgttttgtaaatagtagtgtatggtatataatcacatggttcggtaatttttaggaattgtttttatttttttgagatggagtctcgctctgttgcccaagctggagtgcagtggtgcagtcttggctcactgcaacctctgccccctgggttcaagggatcctcccacctcagccacctgagtaactgggattacaggcgtgcgccaccacacccagctaatttttgtatttttcgtagagatgggtttcaccatgttggccaggctggtctcaaattcctgacctcaagtgatccacccgcctgccttggcctccaaagtgctgggattataggcatgagccactgccccggcctcaggaattattttattgttttgttgcttggaacacttgaataagtatataaaaattctaccttgttgacattttattggttgaagtcatcttggacttttgtggacagtaatatgatgttcctctcatttataggtcactatttctctatgacccttaatttttttatctttctttttcatgtcatcactaactatcaacatctgctaactaaattgatgccttttattcctttgtggataatcttgggtttcacaggcatgcattgacaagttcaggcttgattacatccattgcctgcacacttaacacattttgagaggatcagtgaacagaattacttgtactgtttaaattcaagttctttttgagcatgattatagatggagtcttgaggttcaatgaatatttgatgcaaccaccgtgtatgtaatgtgctagtttccaaaaatgttttttgtttagcacctgtttttcagatagagcttataatatccagatgtgtaagcactatgtccagatttatatttaaggagataagaagcagctgtactactgtgaaaatcgtctttataaaaaaaaaaaattagctactctgtactaccagtaattctgtctacactgaatgtgttactaacgtttttctatctttttatctttagttggattgaatgaacaaatgaaggctgttcgaaagagaaatgagacctctgttatcgatcagattggggaagatttgctgacatgggtaaggaaattttctgtttctttttaatatttttatggacacttgatggttagattcaagttgagtaactaacctttccaaatatgcaaactcatccatgttgcaaagttaatgcaaagctgagaaaggtcaagcagtagattccatttcaagaaaccacctgttttgctcatctgtaagaagcagacccttatccattaaaagtcataccatgagattgcagtgattcagtcacaccttcaggctccactgtaatcctagtttttttgcagttacctcttccactgaagtcttgaacccctcgaagtcacctatgagggttggaatcaacttccaaactcctgttaatattgatattttgacctcctcctgtgaattatgaatgttcttaatggcatctagaataatgaatccttttcagaaggtattcagtttgctttgcccagaccaatcagaggaatcaccttatgaaatatatttcttaaataataagacttgaaagtgaaaattactccttggtccatgagctgcagaatggatattgtgttagcaggcctgcaaacaacattgatctccttgtacatctccatcagaagtctttaagtgaccatgtgcattgtcaatgggcagtaatattttaaaagtaactttttttttttctgagcagtaggtcttaacagacatgctgtcatctaggctttgttgtttcatttatagagcacagacagagtagatttagcattattcttaagggtcccaggaatttcagaatggtaaacaatcattggcttcaacttaaagtcattggcccctaacaagagagctggcctttcttttgacatgctgaagtcagacattgatttctcctctctagctatgaaagttctagatggcatcttcttccaatagaaggctatttcatctacattgaatatctgttgttcagtgtagccactgtaatcaattatctcaggtacgtcttctggataacttactatagcttctactgctatatcagcacttgctgcatcactttgtacttttatttttatggagatgacttcttttcttaaatctcatcagtttacccctgctaccttcaaactcttcgtctgcagcttccttacctctcagccttcatagaattgaagagaattaggggcttgctttgtattaggctttggcttaagggaatattgtggctgatttcatcttctttatacagactaataggctgtttcactttcctcttgttcatttgttcattggagtagcacttttatttccttcaagaattttttctttgtgttcacaagttggccatttggcgtaagagccaaatctcagcttttgacatgccttccttactaaacttaatcatttctagcttttaatttcaagtgagagatatgtgactcctcacttgaacccctaaagaccattgcagcattgttaattggcccaaattcaatattgttgtgtctcagaataaggaggcccaaggaaagggaagagagttgggggaatggtcagttggtggggcggtcagaacacacacaacatttttccattaggtttgccaccatatgtgggtgcagttcatggtgccccaaagcaataaatagtaacatcaaagatcactgatgacagatcaccgtaacagagtaaaatgaaacagcttaaactattatgagaactaccaaaatgtggcacagagacatgacatgagcacatggttttggaaaaacggcaccaacagacttgctcagggttgccatcaaccttcaatttgtaaaaaatggagtatctgcaaagtacaataaaaatgtgaggtatgcctgtacctgtaaaaagttgaggaaaagcagaatggtggtttgtaactgtcacatacaaagcgttaatttagaagaaggcattggccagaaatcataaaagcaaaaatcataaataggcctttagattttactcttgctgtttaaataaaatcattttggaaagtatttttccagtattgtttccttaagatcactttacatacacagacaatccttgacttactatggttccaacttcgacagtttttttactttacagtggtgggaaagtaatacacattcaatagaaaccatactttgaattttgaattttaatcttttccggagcttggcaatatgtggtatgttactcttgatgctgggcagcaacagtgagccacagctcctggtcagccatgtgatcacagggtaaacaaccactctacagtgtactgtactgctagatgattttgcccagctgtaggctaatgcaagtgttctgagcacatttaaggtcagctaggccaagctatggtatttggtaggttcagtgtattaaatgctttctcaacttaagatattttcaatttttgatggttttattaggatataagttcatcagaaatcaaggaacatctatacttaaactgcttgtaaaactactgtagaggccgggcgcagtggctcatgcctataatccctgcactttgggaggccgaggcaggcagatcacctgaggtcaggagtttaagaccagcttgaccaacatggagaaaccccatctctactaaaaatacaaaattagccaggcatggtagtgcatgtctgtaatcccagctactcgggaggctgaggcaggagaatcgcttgaacctgggaggtggaggttgcggtgagctgagatcgagccattgcactccagcctgggcaacaagagcgaaactcagtctcaaaaaaaaaaaaaaaaaaaaaccaaaaaaaactactgtagaactgcttgagtttgggggcattattttctttggtaaacccagctgctttttgtagttgtgtggtgctttgattgactaacatgctaaaaatgctgccagtctccttgttaaacatgttaaatgtcatattcatcatagagtaagaatacaaaattggagtgacctattaaaatattgctttgtatgtgtcctacttgaaaaaatactctgaatttatctacaaatgcgctacaggcgggctttttacaaaatgcctttatgtacaaacttttgggaatatggctttaaatggaagattatatggaaaacatcttcgtaaaccataaagcaattatctacaagtatagaggctgtattaaaaaacaatgtatttgacttctacgagcacctactagtaaatcactttttaggtgtttaaccatcagaaatcttaaaatcatggcacatgcaaacttaaatttacaaattaaaaaacattagtgagaagtataatttttagcaaaagaattcataagctcattgatctcccccaagccagctccagctgctgcacaggtgaaacagcagtgatttaattttgtttcaacacagaaaacttacggcctgcccatggtcatagtgggttttatactgagtaagaaggaatgctagtatgccaaggatttgcttcccagagtagtaagacagtagttgttgtaaaggcttcagggtgtaagaaaattaaattttaggccagatgtagtggctcatgcccataatcccagcactttgagaggccaaggcaggcggatcacttgatgtcaggagttcaagaccggcctggccaacatggtgaaaccccatctctactaaaaatacaaaaaaaattagccaggcgtggtggcacacgcctgtagtcccaactacttgggaggctgagacaggagaatcactggaacctgggaggcggaggttgcagtgagctgagattgcaccactatactccagcctgggccacagaatgagactgtctgaaaaaaaaaaaaatgaaaatttagtctcagtcttcaggcattttgtatcttatattctccaaatgtcagcttgtctgtgtaatttataagtaacgtaggctgaaaggtaataggttgtgataggctacaagcaagaaaacattgggactgggcacagtggctcacgcctgtaatcccagcactttggggacaccaaggtgggcagatcacctgaggtcaggagtttgagaacagcctggccaacatggtgaaaccccatctctactaaaaatacaaaaattagctgggtgtggtggtgtgtgcctgtagtcccagttacttgggaggcagaggtgagaatctcatgaacctcagaggcagaagttgcagtgagccaagatcatgccattgtactccagcctgggcgacagagcaacactgtctcaaaaaaaagaaaaaaaaaagaagaagaaaacattggaatatgatcagaaaaggtctggttgtgtcaagatcagacctttttaatggagaaccattgatattccacatagatatgcagttctgtgtattttgtcacttgaaatattgaaaggattctggttgtctgtcactttgtctggcttgtataagctcagtttcccattctcttttgtgttctttgcattcttggcacagttcagcggaccaggagaggagaaattgaaacatgctgctgctaccttttgcagtaaccaacctttcgccctggaaatgatcaaatctcgtcagaaaaaggattctcgatttcagacttttgtgcaagtgagttgagtgagtcatgtaagaaaaaaaataaggcaagtttttatcaattatcagataaactgggggaattctgactaagacttttacaaagattacatctgtgttaactttttttttttgagacagggtctcgctgtgttgcccaggctggagtgcaatggcacaatctcagctcactgcaacctctgcctcctgggttcaagcgattctcctgcctcagccttcctagtagttaggattacaggtacatgctaccacgccctgctaattttttctatttttagtagagacggggtttcaccatgttggccaggctgggctcgaacacctgacctcaagtgatctgcccacctcggcctcccgaagggattacaggtgtgagccactgcacctggcccacgttaacatttttaaaagcaatacattatctcttaaattcctggaaggtacaaaaatgactttggaatggtgaagaataataaaaaatatatgtcaggattaaaatacttaatatagaaatccacattgccacgaggcttttatcagtaaacaaccgtatgctctattaagagaatattgtcaaagcatgagaatgggtttatccagggaaaaacgtaacagcagccacactcattggggtatatgaattaagggttggtaaactatggccgacagaccatatctagtctgttacctgtttttataaagttttatgtaaatacaaacatggccgcttgacagatttctcacagttgttgtggtgtgtgggtatggtttagcaggttcctcccttgagagtttgaccaggctgagatcacagcgtcagcgggagctgcagttttcatctgatgctcgaggttctcttctaagctcactggttgttagcagagttcatttctttgtaaatgtataactgaggtcctaccttgctagctattggctaggaaccagtttcaactcctagagaacagagagatctctgccatatggccccattaggcagtttagaggtggatgtttgctttcttccaggccagtaggaatgtggctttctgacacagatttgttttaaaggctcctctaatgaaatcaggcccagccaggataatttcctttcttatgatctcaaaatcatgtggtggcaacctaatcataggtgtgatatcccattgtaatcacagattccaaaaatgttcatactcaagggcataggattacacagagtatttacacaagaggatgggaaccttggaggccatattagagttctttactacacagagccttgttcattcacttatgccaaaacagtagagctgaatagttgtgagagagactatatggcctgcaaagcctaaaatatttactatctggcattttactaaaaactttgcagaccactggtatagatgagctggcatactcgactggttatccattgtgcatacttggaatggcagataacaaattagctaaccaattttggtaggaatgtcaatcataggagaatggacctagattttctgaataggtgaagataaaactgtttcaacacaaggaagcgatacgtagagctgcttatggatgctttcagtccttccttaaacagataacaagccattcatttagtaatagaggctcccttcccccattatgtgattaaaggagaaagcagaagtatattgtggcaatgatatatcttggcattttttaaagatcttgatttaataaccagaactgtgatgcattaaaccctcacggtgaatacatggtacatgtataagttcaaataagaattacagattcacttatttcactttaattttaggatgctgaaagtaatccactgtgtcgtcgtcttcaactgaaggatattattcccactcaaatgcaaaggcttactaagtacccacttctgttggataatattgccaaatacacaggtacagcattttcactgaaataaaaagcttaagaacaacaacaacgaaacacccaatatcctgtaaataatatcttacagcgtcctgaatggagttggatttccaaatagtatgacaagattttctttttttttttttttttttccttttttgagacagggtctcactcagtcttgcaggctggagtgcagtggcacaatcatagtttcctgcaacctcaaactcctcggctcaggcattccttccacctcagcttcccgaacagctgggactacaggggtacaccaccacacttggctttttttttttttttttttagcaagggtctcactatgttgctcaggctggtctcaaactcctggcctcaagcagtcctcctgcctcccagagtgctgtgattataggcatgagtcaccatacccagccaagattttctaacaagatatgatctagtcttcttcgggctgtttgatataatgtactccattagtagctttagtacggggtatatcaaactatgaatcatagaccaagtcatgctcactgtctgtttttgtaaataaagttttattggagcacagccgtgctcgtctgtttatgtactgtccctgattgcttttacattataacagcagagtcgagtagttttatcggtgcccatttggcctacaaagtgtaaaattatctggttcaaccatccttgttctagcctgcatcatttttgctttgaagaaggttcatccttggctgaagagatgtttcatggatatctatcaatgacttttattaagccaaatcaatgcggtgtaattccaactctcccgttttgaaacatgaaatgaatctgtttctcagctgagctttaggttcttatacttagctctcattaataatttaatgcaactgaaatcttgtttcttgtgcctgagaatttgaatgcataagcaggaaattttaaattatggtacctggtaacaaaagtggtttacactcatacatattaatttttacactttaatatatctgctcagtgtagttagactgtggtttggaggattataattttgaatgttctgattttggtcttctttgtattatagacatgacatagcctcaatacgttttgtcttgttttgttttgttttgttttgtttttttgagacggagtctcgctctgtcgcccaggctggagtgaagtggcacaatctctgctcactgcaacctccacctcccgggttcaagcaattcccctgcctcagcctcccgagtagctgggattacaggcgcacgccaccacacctggctaatttttttgtatttttagtagaaacaaggtttcaccatattggccagactggtcttgaactcctgacctcaggcagtccgcctgccttggcctcccaaagtgctaggattacaggcatgagccaccttgccttgccgcctcaatacgttttgatgaatttcatcttcttttaatgtaatctattttctttctttaaatataatctcaaattcaaagaaacttgttttggaattattttgaattgtgttattaaaaaattttgtttaacaagttcactggacataattatgtaggctatgcactgtgaaattctgaggggagaagggatttccatttatattatttacaaagtaaatgagacctgcccttctggagtgtatagtatagtggtcctggtacttcacgtaaagcatctcttcttggatttcgggttctgtactgtgatttctttttaaagattagaatttatgttttaaagtcctgttataagaagttttacctgtccaaagactgcttgaattgagactctgacagaggctttaagctggtacaaaaatcttcaaggtcttaatatgctcttaaaagtattgaaatgaaatgaaatctcatttacatatattttatggttttttgctcagttcttttacattttggatttctttcccatatttagaatggccaacagaaagggagaaggtgaagaaagctgcagatcactgtcgtcagatcttaaattatgtaaatcaggctgtcaaggaggcagaaaacaagcaggtaaaaaaggaaaacaagaaggtacaggatgacattgggagaacattaaattaatattacctggaatctgtgaaatagttgttaaaactatcattacctaatggacagggagaacatttgtttactgttcgcatagtaggcaggtcaagatcaatctgtgatagaatatcggagttgtatttgactttttgaaacacctcaagctgcttgtttgctctttcatttatctcttcattcagcagatatttatagaacatctactgtatgctgggcatagggtacagagtagttgagaaaatgagtgcaatatctgcccacactgagcttgtttgctaggaggatagaaaggcatttaacaggattatagtgcaaatattttgtatcagttgtgatagctactatcaaggataatttcaagatgctacgatatataactatggggcctagcttagtttggggatgttaggtggtgcctattagagaaaattttcttgaggaattgacacttgagccaagctctgaaggatgagtggaagtgaaccaaaatgatgtgaagggtgcaaccctagaggtagaggcaatatataccaaagtcctgacggaaaaagaaagcatggtctgttggaagaattgaaaatttacatgagtgtggatcatgcctaaaaagcaaagtcagagtggcataaaatgaggtaaagtagaccaaggccaactcataaaggccctagagatcaggttaaagattttgatttgtcttcttaagtgcagtaggaattcagcatagacaagtaagaatatagtgttcagattttcattatctgaactagtactctatggagaatgagttgaagaagggtggtggatgaaagagcccatttattaacctcttgcagcaatctaggatagatgatggcagcttagagaagttggagaagtatttagaaggtaaaattgacaggacttgatgactgatttgaagaaggatttgaaggaaaagtgatgtcaagaataaacccccaggtttctggattgcatatttggatggacaggatgagtggagaagccccacgtttgtggggaagatgatgaggtcactctgggatatcaggtagacatgcacagtaagcagttggctgtatgggcccacctctaagaggaccatgttgaagataaaaattcaagattgtgagcatacaggggctgattgaatccgtgaacacggatgtagtttcttaggagctgagtatgattacaactctcttggtgaggctgtagaaaaactagtactttcagctgtgctgttcagagtgtaaaatgataaaaccccagagggttatgtagcaatatttatctaaattaaaactctgtaggtacccttatatctaccttttgactccgcagttctgttcctagtgatttgctcaagagaaatgaaccatattagagttctttactacacagagcctgttcatttatgtattatctgtggctacttttgttccaaaacagtggagctgaacaactgggagagagattatatggcctgcaaagcctaactgacattttactaaaaaccttgcagacccctggtatagatgagctggcatactcaggctggttatccattgtgcctgccgggaatggcacataacaaattaactaactaactttagtaggaacaccaatcataagcaaatggacctagattttctgaataataaaatatatctttatctgaagataaagatatacccacaaacagacttagaccagaatgcttatagcaactttattcataatagcgaaaagctagaaacagcccaagaatttatcaacagaatggataaaccaactgtggtatagttataaaatagaatgccctgagtgataggaaaggaatgtaccactaaggcacacaacatggatgaatctcacaaacatgctgagtggaaaaaaaacagatgcaaaagagtacatacctatgattccatttatatgaacttctaagagagaccaaactattctatggtaggaaaaaccagaaaactggttcccattggggatgaggaggtagaaattaactgggaagaagtatgaggaaactttctggggtgatggtaaaattttctatcatgatagaagtttaggttacacaaatgtgtaagcacttgtcaaaattcatggaacatacacttgaaatgtgtgttctactgtatgcaaattttacttttttaaaaagaactgtatggatgtttaaatgtttagaggtaaagtgtacttatgtctgtaatttattttgaaatgcatccaaaaaataagatggactgatggatagagggatgaataaatagatatatgataaaacaaatagagcaaatgttaattgtagaatatagatggtaatatataggtgttcactatgctcactcagacttttccatgtatttggaaatgatattgtgggggaatgtacataccctttgatccaacagttctggaaatttatcctacagatatcctacatggatgtacaaagacatatatttaagtccactttattacagtattgtttgttacagaagagttgaagtaacttaaatgcccatcagtaaggcgtaatgaaataaattatagtttattcagagagttttacatcctgtagtcatttataaaaaaatgaaataactctctatatgtgctaatgtggaacagtccccaagatataagtcatacaccacacacacacacacgtgggggaatacgtatatgaatgtattctaccatttcaatgaggaatacatataggaataccaaaggaatgcatatatgaatatattatgctaccatatcttgttttaaaaaaggacatatacacacaacatgcacaaagacaagcatacttatatatacatatataaataaatacatatctgtttgcatagaatttttctcaaaggctacccaagaaatggatattagtgattgcttctttagggaaaattgaggggggtggggcaataggacaaggttagagggagactttttattttttgccttatatagccatctgaattttgtactgtgtgcatgatttacatattcagaaaataaatataagctaataagagaccaatgactttgaaaagaagattgagaaagaaaagccaaagaggcaggaggaaaactaggagagtatattatcaccaaagccacgggaagagagtgagttttcagtcctgtctagcattgcaaagagctcagtaaaatggagattttttttttttgagatggagtcttgctgtgtcgcccaggctggagtgcagtggcgtgatctcggctcactgcaagctccgcctcccaggtttgcaccattcccctgcctcagcctcccaagtagctgggaccacaggcgcccgccaccatgcccggctaatttttttttatttttagtagagacggggtttcactgtgttagccaggatggtcttgatctcctaacctcgtgatccacctgcctcagcctcccaaagtgctgagattacaggtgtgagccaccacgcctggccaaaatggagattttaaatgccaagtttgattcagaaatagagaggtcattaatgaccaaagcactaaccttggttccaccctgcctaattttcagcgcctagaagattatcagcgtcgccttgatacctccagcctgaagttgtcagagtacccaaatgttgaagagctcagggtgagagatggtctaatcataatttaaaaaataaaataaaatttgctaaagacctggcaggtaattaacatctcagtgggaatatacgtcacctgaaggagttcttgtatcgtagattatctgtatttatgattttttttgctgccttttaaatgcttgatctgtatgaaattagtttttcattagaggaatatcttgcataaaactgtaatattacatgacagcaattggcaggagactaagggacactaattattataaaatttaattttattgtgttctgtagtttgtttcagacagggtcttgctctgttgcccaggctggaatgcagtggtgcagtcttggctcactgaagccttggcctcctggactcaggcagtccacccacctcagcctccctagcagctaggactataggtatatgccaccatacccagctaattctgtgttttgtaaagacaaggtctcgctgtgttgtcaggttggtccagatttcctgggctcaagtgctcctttctcagcctcccacagtgcagggattacaggcatgagccactatgcccagcctgtgttctgtagtttaaataagggtaggactgtttggtaactttccagatcatttaataacacaagatagcatactattttctcatgaggctcttcagaagcataaaagttggaaccattacaggaacgatagtaaaatgtttactaattgccacttctagtatgtgggcttatgtgttaactttttcggattttaagtgtttttgtaccatttcactaggtggtggttttggcagatttatttggtggctgttaaaatagacttttatgtcatatattaatacttcgtcaacaagcacgtaaatgtgcttattccccttagcttccaaagaatgagagttttctagagctgctaatactaaaagatgattctcttactaataagttgttaatatttagaccaagtctgagtagtacctggacttttcatgagtactatttcttagaactttctttgaaattagagccttggaactcagaagccactttcttatagacaagcatatgtaccatgctcatccagttattcataggaaaattaaaggatacgttgagaatctagtgactgaatgtttgtaacttgatcttcataatctgttatcatctgtttagagtgaggtttgaagatagtactcctgaatgttcttctgcaagataccttttcctttttagaaaattgtatgcagattactttaatatggcttttgtgccattttcaagaactgacaaatagcaataatgatagttgaatgtaaatggtgtattttatattaagaatttctttaaaagagactgtattatatagataatcatgttactgagtgcttggaaattatttgtgcatgattttctttattttgccagaatttggatttaacaaaaaggaagatgattcatgaagggccattggtttggaaggtgaatagagataaaactattggtaggtctgatattgtcttttagttttggggagagtggcaaaagggaaggaataggaaagtttcctatgacaaagggaagaggagagaaccattctctcagcagtttgcagtgctacctcgtgttatttgtacatttgtagatctgcttgtgttatttcattatatgtaagatgtgttaaatattcatttaggaatgtagtggagaactgatttagtcctatttccatcattcttatagtctagtgagtctttgtatgctttgtaagctttctttagaccagtacatcttaaactgtctgtgatgaggaaccgtttttgttttttcagaaacaaggtctttctatgttgcccaggctggagcacagtggctagtcacagatgcagtcatggtgcactgctgcctcgaactcctgggcttaagggatcctcctgccttagcctccctagtagccgggactataggcgcacagcaccacacccagcttgttgttttttatttcctattggtcacagactgacacttcagtgaaataaaataaaaatgaattactgaaaatgaaattttaaaagataatatacaagtcaatttttaaaattttgtagctttaacagaaatagaattcctctgttgaatcattataaagttaatcaaacgcgtctccatttctgtacttaccatttttttctgcacttttatttctagatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacaggcaagtatgtccactgaaggatactaatttccagattcattgtgaagttgcataagatactcggtgctgtctcaataacacaagtggcatagagtcttgctatttttatattcttaagcaaattacatgaaatttactgcttagaaagagacctaagagtttataccccaaagttattagggtgtctcgattctgtgaacagttttctgcatttgaaaatttttatgctattactttggttctttatgttcaaatcattgatagatcccaatgaaaagcctttcatttagggtggtatgttttttgatttggtgagaaaaaaatcaaaaaccaaagagacggatgtagtgttgattaaaaatcaaatttgactggcaagttatattttaactctattaacaacggggtcccttttaaaacttgttagtttcatggtggcaaaataaatttgtgacctcttttctccactactcactgaatattattaactaacaacttagcaaaagtgcagttcaaaataaatgcaaaagagtaatagcatttaatctggtaatttggatttatttattttttttcttttgagacgagggtcccaccctgtcacccaggctggagtgcagtggtacaaccttggcacactgcaacctccacatcccaggctcaagcaattcttcaacctcagcctcctgagtagctgggactacaggcatgcaccaccatgacctggctaatttttttgttttatgtagaggcagggtttcgccatgctgcccaggctggtctcgaactcctgagctccaagcggtccacctgcctcggcctcctaaagtactgggattacaggtgtgagccaccgtgcccggccagtaatttggatttttgacatgcttttagcaaagtttctagtaaattattgtggaattagtgctaattcgtataatctttgttttattgaagtacaataaatatagtacaataaatacgttaatatggtaagttgcacaaattttaagtgtacatcttgatgaattttaaagtaaatatatgtaacctttatctagtttaaggggcagactatttcaagaccctaaaaacatccctcatggcctccccaggtcatagtattagagtaatcttgtattgttttttccagataacaaagctttattcgtcatttccatgtcagacaatggcgctcagatttatgaactggtggcacagacagtttctgaaaagactgtgtatgtatcagatatggctaccttgctatagctaatattttcattatcccaagcgtaatattccataaacttaactttgtttttataatgtatggaaaccaagcacttcctctgtactcttttagagacgttctactatgaacttgttcttttttaggttgatgccttttattttgattctattctgaaagtttatttcctaaagaaaaaattgtgcaaaatgtcaagtgaagtttttttaatgtgtccatagatttctcttaaggtatagttttggactctcgccttaatagtgtgttgccaaaataaagatattctctggcagagtgggttttgttgttgttgttgttgttgttgttgttgttgttgttggttgatttggtttttgtttagttttgctttctgagtatatttaaaggatatttcttttttcttttttgtattttggatttctttccaactttctgaagctggcaggacctaatctgtcggatggctgcatcagtgaaggagcaatccacaaagccaattccattaccacagtcaacacctggcgagtgagtgttcctttgcattgtagtaggacttattttatgttttgggttggaaaagactaggataattattatgttttgttgcgatgatgtttagatacctcaggaaggtaaaagtttttttttttttttttttctctacagaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagataggcgtatcacctgaggccaggagttagaggccaacctgaccaacatgacaaaaccctgtctctactaaaaaatacaaaaattagccgggcatggtggtaggtgcctgtaatcccagctacttgggaggctgaggcagggagaattgcttgaacccaggaggcggaggttacggtgagccgagatcgtgccattgcactccagcctgggcaacaagaccgaaacaccaaaaaaaaaaaagaaaaaaagaaaaaaaagaaaataaaataaaatgcaaagaaactttaatactgtttggtttatgcaggttccagcatcagagattcagtttaacaaactttgcctttgagccttctgtgtgtcagtataacactgttctaagtgatgtgtatttttcttaacagatgatctctgtagtttatggattgttttttttttttctgattcttccctgaatgcttcatgttaaaagttaaaagctttgtttagatatagtctaccttttctattccattggacagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaattgtaagttttattcataacttattacagatacttactaagtatgacactcatgtgccatccctaaagtatgtggatttatcaaactccacttattcttctagttctattgtggagattatagtattctctacagtggcccatgccacaggcacacacacacatgccactctgttagctccccacccccctgcctggttcagaatcactgttaaaatgggaggatagcatatctctcagttgtattgaggtgggaaaaaggctgagaacaatttctttggctggggagaaccacttgaaatttttaaaccagcgtatgactaaaggtatgaaaaaagattaatctggctgaaagcggtggaaggatttgaatggaaagaggtatggaatggtgtacttactaaataagctattataatagtctggcctgagactaaaagagtttggactagaatgttatcagaaggaataagaagaaactgagaagtcatcaaatgcttaaaataattgacttctttgaatgtgaggtcaaaggaaagggaatatttagagataatttcattaatctagtcagaaataagagtcagaaaaggactaccactgcttcccccacctccttccattgtactttcttttttctttcttttgatttggtagaattataggctcagttttaaagcatgtcaagattaagataatgaatgacaaaacactaaaaagtgagtaactagcaggaagttagagttttaggagtgaaactttagagagaggttaggaagagatagagatgtgagcatcagagccatgagacttcctggcatctctcaggaagtgattgtagagcagaaggacagaggatgagagacctaagtggaacctgttgcctaaagaaacatgacagacattaagctagtgatgagagcagagaattggttatttaaaacctacaatattttttataccttctcctgaattaacagtcttaataatttctgatggttggaataacattgtcccaataactctatcattgtctgggtgacctcatagcatacacttggcccattcaaaattaaattggttcttattttcagtaaatgtatgtatctcataaaattagaggaaataatatgcatatagtgtctggatctggaaaaagcagaacttttttttagctttttctgtctagcttaacacagcctttcaacattcttaagaagtacctttagggtattattctagttatatagaagaaaaaatagaggcatgatattggttattgaggagttctaaatagtagtatctccctattcagaatgcttagatcttttcaagtttagtttaacgttaaatcttctctaaaagatggtgctttatttcatcttcaaaacaaaatggaaaatgattgtatgaagtaagatgattgtatgaaattaataattaacattttaatatgtcattaaaagatactttttaaagatagatcattggtaagtcagctaatttaattcttgcagcctgaggttatagttgtgaatatgttttttttccccctccttcctaaatcgtttagtgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggcaagtatctttcacacttaaactttgattttgattttgatcattgttaactgtcctgtattttgaaatggatgttgtattggtatccaggtgtgtgtgtgtgtgtgtgttcacacatgtgcaatatttattccttcatttgataaatactgaatctactctgtaccagacctcatcataggtgctgggagatatagcagtgaataaaacacagaaaaatcccatcttctcatgaagctaggggaaagaaggatggtaaataagtaaacaaataaatagacttcaggaagtattaggaagaaacataagtcagactgaggggacggagagtaatgaaggcaaacagggtgatcagggattaggacctccgatgaggtagcatttgagcagagacctcaatgaaatgagggaataaagccgggtgggtacctgggagcttactattccagcagagagcagagtggggcagaggctttgtgtcaaagagcaagctttttgtggtgatcgaacactggatgagggagacaatggcaggagatggggcaagagaggcgtttggcaggggaagtggtagcaagatcatttaggcactgtagtttccagctttaaacttttgaaatgaaattttttggaaattaccatgaaagtttgcagagtttagctttcatctgaagtgaggaaattctgatgtacctgaaactaaactcaggaattaatggcttttccctctcttaataacttttcaagttgaagttgtcagcacactatgctatttctgttttctaatggcagcactggtcttatcaaactattctgtctctatccataggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaaggtacctcatacttccacatccataggacttggttgtaagaaacatttagcagaggggaagaatagggtgatgaaaatgctgatgtcaataaacttgttcaggttctagatttctttgactattatccatgaataggcctgggtaaaaagttgagattggcattgtttatctttttctttctttctttttttttttttttttgagacggagtctcgctctgtcaaccaggctagagtgcagtggcgtgatctcagctcactgcaagctctgccttccaggttcacaccattctcctgcctcagcctcccaagcagctgggactacaggcacccgcccccacgcccagctaattttttgtatttttaatagagacggggtttcaccatgttagccaggatggtctcgatctcctgacctcgtgatccgcctgcctcggcctcccaaagtactgggattacaggcgtgagccaccgcgcccagtcggcattgtttatcttttgactatcacaagagcagaaaaagttgcagctctgtgaactgtgtgtttgtatgggtgtctaagtttaagaacctgaaatgcttcgggtagttggctggcctctgtcagacatgaacaagaagatgagataggtagggtttatgtagttatgaatctaggctgagaaatgctatgactttctgtagcctattatctgtgactcattaggtgacattggcagcttcccaaatcctatgacagatagaaattggcttcagtggctcctgtaatctaaaaacatggtcatgcatgggatttttgtagattggtaattgaagatgtcactattgcaaaactgacttgtgtggcaatttccaagagaaagacctatcttaaagttttccatcagaggcagggcacggtggctcacgcctgtaattccagcactttgggaggcaaggcaggcggatcacgaggtcaggagatcgagaccatccttgctaacacggtgaaaccccgtctctactaaaaataaaaaaaatcagccaggtgtggtggtgggcgcctgtagtcccagctactcaggaggctgaggcaggagaatggcatgaacctgggaggcggagcttgcagggagctgagatcacgccactgcactccaacctgggtgacagagcgagactctgtctcaaaaaaaaaaaaaaaagtttgccatcagaaaacacagcttccagagcccaaacattttcctcatgacatcatttacaccagagacttgaggggtagatttaagtatccttagcctttgagttaaagactggtctcccttagtttctcttttaccttcatataattgatttttccctcttcatgttacttattttatgtagtatcattctgtagctgatgagatatcgacaagcccattgaggacaggtcggttcttatatacagtcatgtgttgcttagcaatggggatatattctgagaaattcatcattaggcatttttatctttgtgtgaacttcacagagtgtacttacacaaacctagatagaatatatctttatttacatagattttttcatatggaaagccaaatctctcaacactattactgaatattagtcatttcccctacctgatcagcaatgccattattaagtgccacacaccaggtttctacatgtgctccataataatcttttttttttttttttttttttgagacagtcttgctctgtcacccaggctggagtgcagtggcgctatttcggctcactgcaacctctgcctcccaggttcaagcgattctcctgccttggcctcccaaggagctgggactacaggcaccaccaccatgcccagataaatttttttttttttttaaatggagtctcggtctgtcacccaggctggagtgcaatggtgcaatctcggctcaccgcaacctccgcctcccgggttcaagcgattctcctgcctcagcttcctgagtagctgggattacaggtgcccgccaccacacccagctaatttttttctatcttttaatttatttatgtatttatattttttgagacagagtcttgctctgtcgcccaggctggagtgcagtggcatgatctctcctcactgcaagctccacctcccaggttcacgccattctcctgcctcagcctccccagtagctgggactacaggcgcctgccaccatgcccggctaattttttttatttttagtagagacggggtttcaccatgttagcctggatggtctcgatctcctgacctcgtgatccgcctgcctcggcctcccaaagtgttgggattacaggcgtgagccaccgcgcccagtcccagctaatttttataattttagtagagacaggatttcaccatgttggccaggctggtctggaactcctgacctcaggtgatccacctgcctcggcctcccaaagtgctgggattacaggcgtgagccaccatgccccacccataataatcttaagggaccatcatcatgtatgcaggccgccatgtctttatgtgctgcatgactatagctcatgcacatgatgacgggaccatgtccagggtgactcctgggggtgggagaattgcatctatggttaccacctctactttctttttacatgggaaaatactaagttattccttcagtggagaaattggtaaaaggaatgaaatttacttttttcttcccactaatgaaatttttaatgatgaagttaatatttttgaaatttgggggcttgtacctgtaatgtaaaaagggcttcttttctgttttctgaagtttttgttttgttttgtttcattacgtttgaataaaaaacctatgggttttatttcacagaaggtggaggaaagttacaccattctttgccaaaggctggctggatcagccctcacagacaagcactcaggtatgtaaaagttatgagttccagactctagactaatcatcctacactgaatgaaatgacttatcatactttgaagtgaaaaccttctgagattccatttctcttctgtctttaaagaactgcctgtttctaaacatcagatatcaagcggaagctcatgcctgctgactctactcttctctaagaggaactgcagttgtcagttcccataccatcccctcttctctctcttttcaccttttcaaagcagaaggcagagcagtgggaagcctggtaaatcacagattcggtgtgaggcttactggtactgctgtgactccctagtgtggaggatttggccttattggatgttggtgcacttgcctctgctgacagtgtggctggtgtctcccctgactgcagatggatttgtgttccctgcagcagtttatactcatctgcttacatactgattcagaaacaaagattgaaccacgcccacagatgtcatgggtattctttgcaatgttagtatattctttttcttaatatcatttccatgtatctttattcttctcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 6 - DNA, 153525 bp, Homo sapiens
  source 1..153525: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggttggtatgaattcctccttcgttcggcctcccggaatcgggcccgacctagcaggggagtcggtgattgcagattgcctttggccagcgaagttgacaggcagaggaaagagggttgtttcggagctgtgcagttagcctggggttgctgccgagttatccagttgattggcttttggaaatgtaatttttccggagagaaacttcccttccgattctcagagaagggggaggcaaaaccatgattgtggttttccgcctgtagtgtgcattaggattgtgtactcgtctggaaatcagaggagaaggtcattttaggtgaaggtcggtgcctgaagtcggctcggtattggtgtattatttatcagctttagccgtgtcctgcagtagattctcaagacaattacattttaggaatttctacctgtgaacttaatgttgagcctactgcatggtgatctgggaacttgatctctttcagatgttgacctgcacggtgtttaattattatctaataactttccagaatgttgacattaccagtaaatcacaggttcttgctggaagcaatgtccaggagctgaagaaatgagggtaaatcatggggtttgcttttaattcttgtatttaaatatttcgtcttccagaaacacttggcgtttaagagatataagccgtaagcatagtgtaagcgcgcagctgaatttgttgagttctgtgtctgtcctttatagcacctaccagtgttgcatggtggtgggtggcgaattgagctagaccatgtgtggttgaagtgcagtttgcttatcctaagttactcttgtttatagggtaagggataaaaagcatattgattccttgaccacatttcattctcaatttaattatgacactgcatgctagtcccaaatttgtcagcttgctttatttttaagtcagtcttcgaattattacaccgtgaaaaaatagatcaagtaactgaattagagggccaaagctctttgatgaaaagtgcaacaatagtgcttctgcacaaagtagtcttaatttcctaataagagttttacccaattgtaagactcatttgttgattttaaaagggccaaattccattatcataccataacagctactccagaaacagaacttcctcttcctgttgatgctttccagcatcacatgaatgttcacttaaaagagtctgttaaatatttaaagtatttatatttactctttgtgtatttttcaaagtgggttttcattttcaatgaaataatttttaacttttccaagaatacacttaagataagtattgacaatgcttatcttactttcttctggttatccccatttttttcctttcagggtgttttgcttctgagaaatcacttttacgggtgtggggataattgttttcctgcttcattcaattctcgctctttctgttgagcctgtaaacaaaagtcttgctaggaactaatgtaatgttggttttcattgcgatgctgaggtgtttaatttatggaaacagaacggactcattccacacacaagtgagtgaaaagccctcaagtaatggtttttcttcagcattgcttctcagggattttccttgtcttctcgttatcttggaaatagaatcttggaatttgtatcctctttataacgtagatggcatataaacattcaataaatatgaaattactgaaagcctgtttcttttctttttcttttttttttttttttttggccaggcactgtgcaggcacaagagattacaaaatgaatattgtaagattaatctgcaaattggtttgggcattaatgttttttgaactggttcaggtgctgctgcctaattttacattttttttttttaaagaaaagaccttggaaagccaattaataagcactgctgagacctgtttcgtaggatttttttttactagggtctttttttattaagaattattcttatttgaccacatttaaatatattttgtaaatataaagcatccatttgctgttaagagagtagttgttcctaatatgaatatatgttggggtgaaatctggaggtactggtttagtattatttctctgccaaggtgtcttaacaaagttacgagtatataatagtttctagctttctgtcagccctacctcatccttttttcgtagtgtctaactcttactgtaggtatattttgctgactctagaactgttggaaaattaacagcaccagtgtagctttttagatagagatcctttcaagtttgaagtgctgtatgtggtatggctttgtttcgtagagtgtgcagaaccaccaggccagctgtgtgagttagagttctttcattgtggtgcttctgactacagagtctgtctgtcctcagttgaaatcagactagctggttttgggcgttgttctgttttgcagtttgtggcaggcgacacatggctgaacaagataagggttttattcttgtgttagggacgtgctggggctgggatggaattcagctatgtttaggctctgattggtcactttggatactcagaactctgttacatcctgttattattttgcagttaaatcaacacattaacttgctctcttctctttcccttcatcttttactccccagtccgcaccccttaaaacctaaaactcaaactttttaaaagactttaaactcaaactatgttcatggtagctattacttctatgtagtatatccaaacagctttaaaaaaaatggtaagcaatttatgagccctggagtctgtagttttcatcgtttagaatgagcacttgacaagtgtagaaatgtctgattgctgctttttagtctgcattgattgctgcattcagtcttaaaatacatcctaatcgtttccaatcctcctacatgtctttcttgtatccctgagaatttaggggtcctatagcaattggaatttcttctgagaggtagacaggagagaatgcccttttagtagactcagtaaatgatttcaggccagtgtctataacattgaattttcagggacagtacaggtaggaaagttatagggttcttccttgaaataaatggacttttgttttggctagggcttatgaattttgtagtttttgatttatagataaagacaggtttttgatacaatttttttaaagcactgaattcagctttgagctgtttaacttaagcagatttttaaagtgagtgtggaaacctgtgactttatatgcctgtacccagtaattaatgatacttttcattagtgatactttttctgtcaaaattgctgtataatggttttgattaaaaaaaaaagagctactcatgtttatatgttattttcaacgttgcatgagtcatctctcggcaaggtgaaattatttgtaaccttttcttgtaaagtcagccagtccataaatacaaaattgaaatgggggccaaagatcacagtgttagttttgtattcagttttatctttgcctttttagttcagtataaaatcttgagtcataaaggtatgcaatagtacattcacttgtacagttttacatgagtcaacatgcagaatctaaagtaactttttttgaaagtacagtgttgtagtcttcctgattaatggtacatttatatgatgttcatattcagtaaggtgacaagagaagctttatttgaaatcattacaaaaatatgttaaccttggaataccacttaacacattggtggtttccggttgttaacatgtatataccatcgagttaacatgtaggtttttttcttttttgagtcttgctctgtcacccacggtggagtgcagtggcgtgatcccctcactgcaacctccgcctcccaggttcaagcggttctcctgcctcagcctcctgagtagctgggattacaggcacccaccaccacgcctggctaatttttgtatttttagtagagacggggtttcaccatattggccaggctggtcttgaactcctgaccttaggtgatccacccgtctcggcctcccaaagtgccgggattacaggcttgagccaccgagcccagtggttttttttgttgttgctgttgttgttttttaactaagtttgagttttcagtttaaaaaatgaaatttgaggcaaacattcatggaatccataaatggtgaattttacatatgtttctgtggagcattgcgattccagggaaaacagttggaaaatatttcattgtacatatgtggttgcctcttctaaatgtcatccagtggtgggtatgaattgcttcccaaactgatacgggtcacagaaacagcaagataacatactggttcccagaggtaattgaagggactcttttgcatcatggttgtctgacattattagaaatgtttcttatatacttgcttgtttcctagaaattgaccatgacacattttcaagaatagtagcttaacttcttttggtcttttctgttaaaacttggttttgatgatgttcctgagctttatttgaagacatgctcctttcccttataataattacaggttttcaaaatagtgccatgtgagttaaaatttttaaatcaacaaaattatatttttgccttcttttgagtaaaataccatcatgtaggtaatgatatcctgtggtagtataattctttaacatttacaatattttcagttcagtacagggcagatcatgcttctgtcatttacactttaagctaattcatacagtttaagtcaagattttaagtcaagattataaaactagaaagggcagacccaagattttaacctagattttctggctctcaagtcccccattgttttttttcattttaaattattgtctttctttgtactgtatttttctgtgctattttcctttagtaactctccagcttgatgaagtcagttggatttttctcttacagcatagtttctagtaccttacccattctaattttaaatatctcttgaggataaagcttttgtcacttcctcaggagactgaagcacagtctgatagatcttgctgtcaggaagtttttcctgatctttacgtctaacttttcttttaagttgtcctgttacttgtatgtacttgctgtaccaggctaaataatgctctcctcccattttatgtttgtatgattctaaatgtttcagacggttattcattatcctttccggtccccttcccttactctttgcttagccaagctgtatgctttctgttgatccattgtctaaaaatcagcttatcttaatatttcattagctttttctcagttgctctcctactgcaaaaatatgggtaaagagattctcaaggtcattttgattcacttttattttagatagtctttaggatggatatgagatatgtcacagtcaaatgaaacaaatttatacaaacagcatgattaccaaatcaactaattaagcaattactcatgttctaaaaggcttttttacaaagcgattctttcaaatatgagtaccctcaatgtaacaaatgttatcaattctatgacaaaagggtagggtatagaaataatgttagccacctttgatggaaaatcatcttgttgcaatatgatgaaatacatcaggaagttgtttcttattttttccagtggtttttcagttcgttatcttaaattgtaggtcaaaacattcctcgatgtttggtttatttttaccttattgttttgtctcctcttatttccacatgttagtgaaataacaatgcttagcagtattttttttttcagtaaaatggatattgtgaaaattgaaatattttactttcttgctgttgtatttacaagaattgttaatgacaagacagtgtaacagaaaaagtgcatatttagattattataaaatctgtaagactgtagaccttttgaatactttattagcatattttctttagtactattttagtttcaaattattgagatagatgtccttgttttgtattttgctaatattaatattttgtattttggtaatactaaaatttgcaaacatgccaaatttagagcattttactttttcaacttagaatatctggaatcatcaagatagtcatatagggaagaccgctataagacagcttctaactccaatagaagcctatgaagctagtgcctggtcagaggctgtgcctaaattgcatgagtatatagtgtcgacttttagtaaaagaaaaaatacactaactttacctcttgaattagcatgcaccaatgcagtttagattcataccgaaacaggatcttttactaattcaaatgctgagtcctggtttttgagatcacagtcacatgacaggcctgggtggcttctcagtgtctagagacaagcaaatctactggccaatgaaaagtaggtttcctgtcttggactgcaagtaacaattcatgcagaaattggaactatataagagagcctggttttagttaatgctttcaattagctgcttgtcacactgctttttcttttggtgttatataacacattagagtcatttaaaggtacactctgatactacagtttttgtcaaatattacatataaatgttgattttacattcatatactcaaaagatcaaagaggactttgtagatcttttatggattcaaaaaaatgtagattattttgttgtagaaaaactggccaggcgcggtggctcatgcctgtaaatcccagcactttggaaggctgaggtgggcggatcacttgaggtcaagagttcaagactagcctggtcagcatggtgaaaccctgtctctattaaaaatacaaaaatgagccggaccaggtggcacatgcctgtaatcccagctactcgggaggctaagacaggagaatcacttgaacccgggaggcggaggttgcagttagccaagattgcaccactgcactcctacctggatgacagagcaagactccgtctcaaaaaaaaaaaaaaaaaaaaaaaaaaaaactggagacttcatcagcctctgaaggaatgatacctgaaattgatcttgtaatgcagaaagtggctatatgttatccagaagagtaacagataccccaaatacacttgctaacacaagaaatcctgtgaaggtgcttagacatacccttccatagattttagatgggttatctgcctatgttccagacacaagccgatatgttgtggtttgcccagtacagtctctgtggtttactgagaggaagtggttcttgtgggtgaaggtctgatcttttcagagattgttggtggcatatgcactgtcagcctatttcctgttttattggctgtttagcaagaccttcttagggcaagtgctgctgaagaggtatttaaatattttgtattggcaggatagatggttataatgatgtattattatatcactacttctcaggtgatatgagagttaaatgaatgtttgtgaagtgctttgagatcttaggatgaaaagtacagacatgttcttagtcatttgcaggttactgctatgttcagatattgctctcttgaagttaaaacttgttcatgtagtaaagtgttactctattaaacttgatttctgtaaccattcaagtgttgttttatcaccacaagagtcatgattagaatttttcccctttttttcctttctttcaatgctcctttatgattttaccctagaagagtttccttaatagattccttgctctagtactggttaaggcatatttaccaaacttaacacctagcaagcttgtccaacctgccttattttgctgttgttcttctgttttgttttgttttaggctttcagcagcctgaagccatggtttttagtttctgtctctagtgataaaacggaaagagggatgaggaaggggctttactggcccatccagaaacagaaactaagaacccatgactgtattctctcccttgaacaactgtaactagagcaaacctctttgccaatttaactggcatactaaaataatgaaattgtgagaatttcctttgagattagtaactgtaccatccatatacaaaacactatattgctttgctgaaacctgaaagtgagcaaactgatagaaatgcatataacaggccgggcgtagtggctcacgcctgtaatcccagcactttgggagaccgaggtgggcggttcaggaggtcaggagatcaagaccattctggctaacacggtgaaaccccgtctctgctaaaaatagaaaaaattagccgagtgtggtggcgggtgcctgtagtcccagctgctggggaggctgaggcaggagaatggcatgaacccaggaggtggagcttgcagtgagccgagatcgcgccactgcactccagcctgggcacagagcgagactccgtctcaaaaaaaaaaaaaaaaaaaacgaaatggcgtatgtcatactcctaaatatatatatatatacagtatttagccttggacgttaaaaaaattaacaatgaatgggggaaggctttatttaaagctaaattgttagctaatacgtgagttcttcaagggtataagaatagttcttattcatttttaagtaattatcggtagccttattatatttttattttttaatactgaaaagcagaaggaagaaaaataaatggcccaaatgatccaactacccagatgttgctgctcaggttaaacgcacacacgcatacacacacagaaaattcaaatcatataaaatggtataaaaaaaagtattcctacacacctgttagttttcataccttctcctcataggtaacaatagttaatttttttggtttatcttctgaaacatttaaaaatatataccagcctataattttattttttgcacctactccataataagtgtatctgtcttcttttgctaggttatgctgctgtagcaacactatcaaatttcagtggcttacaacactgcttttcttcttgcttatgctacaccttgtcagctgtggattgactgcagcattgcttcacgtttcttattttggaaccctggctcaaggagcatcccctgtctgggctgtgccattattgtggatgagggagagagcaagaaaacagatgcagacatacaatggctcttaaagctttcactcagtcatgttgtatgtcacatcagctcacatgtcagtggccaaagcaagtcatatggtcagagctcactgtcagtggggtaaggatgtatagtccttccacaggtggcattgcaagttgcatgataacagataaggctgtataatcctcttaaggaaagtggaggttaaataatttggaacaataaataatatagtctacatcaacaagttcagtaaatgcttgttaaatgggttatttggagtctatgaaagtttctttttttttagtgggaaattcaaacataaacagaagtacagagaatggtatgatgaacctcccttgttccctttattactccagcagttaatgtacggacaatcttggtttatctgttttctttccccccttctcactagattattttgaagcagtttttggatatcataatttcacttacaagtatttcactaagtatttttaagagataaagtctgaacgtgtgacttctcatagtaaattattactgtctgatagggtgaggtaatagtactatatagactgacaggtgtcaagcagcagagcacgttcatagagcgtatctagaatttgacagcctgaacttgttttgatttcattttgagtatttctggaggaggcttacaacagaatgccatctacttttccagcctctccctttctttctttctttccttccttccttccttccttccttccttccttccttccttccttccttcctttctttctttctttctttctctttctttttctttctttctttctctctgtctctctctgtttctctctctctctctctctctgtctgtgtgtgtgtgtgtgtgtgtgtgtgtgtgtgtgtgtagcagaagcaggtaattaacctctggaaaaaataacattgcaacagatttgatttgcagaggtttcatttctcactgagcctctgttggaatgatgccagttgaaaggaatcccagctcttaatggctccaagtcttctgggagctctcagtgatgttattttctttggagaagaacatcagaatcatttataaaaatcctgtgttcacccatgccatttgctctgtggagaaaggatctatcatatctttaagatgatctctaagatgatataaaagtaaagaaattcatctatctaattttagtttagaaatcattaatgccaatttcagctgctcaggttagtttgtcttgaaggcctgaaagcctccattttgattcaagatgtcgtagattttatgagcattcagtataaccagtaagtttgtcatttccatggttgtagggaatatgagacattctgttatggatctaggattaccgtttcacaggacattctttttttggggggattgttaggtaataaacagtgggacacaaaataaacagatataatctcttcagtttgtagattttcaggtgacaatgaggtggcagaagaggatttgtgcagattaggaaataaataattattgtatataacatgatggaaatattttagtatagtaccactatcaaattaattttgtttccttaactagcttctttcattgtgtacagagacacttatattaaagtagtctttatagatatccagttagctttagttttttctaattacattatattgctagtctcatttcagagtccatgtaggaactacagtagaaaagtagctatcattggcttgtaaataaaattacttaattttgagtttttcttgggaaggaaaaaccagttttacagaattagtggagttgattctggttttggttacttgtgacaatatagtctatttaaaatataaataaataaaaatttgcccaagaagaataagtttgacttgccatgattcatactgtttttctgttgttgtatcacaattgagaacattagtttcagaggtaatagtttgtcagtatgggtcgagtagctctaatccaaaaatccaaaatcagaaatgcttcaaaatctgaaactttttgggtgccatgtgccacaggtggaaaattctacacgtaagtacataatacaaactttgtttcatgcacaaaattatttacagtagtgtataaaattaccgttaggcgggggccaggcatggtggctcaagcctgtaatcccagcactttgggaagtcgaggcaggcggatcacctgaggttgggagtttgagaccagcctgaacaacatggagaaaccccatctctactaaaaatacaaaattagctgggcatggtggcacatgcctgtaattccagctactcgggaggctgaggcaggagaatcgcttgaaccagggaggtggaggttcaagcgagccaagatcatgccactgcactccagcctggaaaacaagagcaaaacaccgtctcaaaaaaaataataataaaaaattaccttcaggctgtgcatatagagtgtacgtgaaacattaatgaattctgtgtttagacttgggtcccattcccaagatatcttactatgtatatgtaaatgttccaaaacacaaaaaaattcaaaatgaaacacttctggccccaagcattttgggtaagggatacccaatgtgtacctttgttaggataatatacttgtaccttggttgtattttagttgcaattgttagttgcacaatttgggggaatgtttgaggtctctatagtagttactgtatttaccaggaagccctgcatgattagaattcttgagacagtgtataaagttaaattgggtgtgttgcctggatgtgaacagtaaaaaaggagaagcttctcaccatacaattatagcttaaaaggaaccaggtacaattctgtttccaaaaatagaaagtaagtcaaatattatatggatatgtaatagtaattatattaattttgactccctggccgactttttttttgaagctatcattttttgtcagagataaaaagtagcttttaaaggaaaagatatctcagcccttaattatgtgtgtgtgtatgtgtgtgtatgtatttatttatatattttagcccttgtaagagaggagcagtggaagggaactgaaggagcatgatatagagaaaagagcctgggttttggtgtgttgcatttgttctgttactagctgggagaccttgggcaaatttacctctctgatcagcagtttaattttttcatctgtaaaaatgggaagaatacctactttgcagaattgtcgtgacgattaaatgagagtgtgtgtgagtacctagcacatcgtaagagagagctcagtaagttatagtagctgttattgtttaaacttcaggaattagctaggttttgctagaactttcatctgtgcttgtaagatctttttgaatccatatgtatttttagcagctgtggctaagatagtttttttcccttgctgtgataatattccttatcttttatatttcaggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagttctgtatttattaacatcagtttgtttatttattcagtaaatattgaatgcctgttctgtgtaggtcattgtcttggcagttattttgagctcttgctacctgctgaattatatcttaaaatgaagaaatttacatgatagagtgatatttattcatctgtgctgaagattaaagtgagaagtatgtggcaggcgcggtggctcacgcttgtaatcccagcactttgggaggccgaggtgggcggatcatgaggtcaggagatcgagaccatcctggctaacacggtgaaaccccatttctactaaaaatacgaaaaattagccgagtatggtggtgggcacctgtagtcccagctgctggggaggctgaggcaggagaatggcttgaacctgggaggcagtgcttgcagtgagctgagatcacgccactgcactccagcctgggtgacagagcaagactccgtctcaaaaaaaaaaaaaaagtgagaagtatgtgtatttgggggaagttgtagaatgaaataataatgattaaattgatcttatttccaaattttaaaaatgtggttactttctatcacatactgtctttttatgttttcctttttattttatttttcagtttagttatatttcagtgaactatttagaccaaaatggaaaagacattggtgtaagttggaatctaagaagttttagatgttcattgcttttgaacagaggaagtaacattttatggattgggcattgttttagtcactacttgaaggagaacctcttactcattatcagtctcttggaaatagcaactgattaagcctatatatactttgtgcatccagtgaaaatgtgataaatatgatgatcttttggtcagagaaggattctggaaactgcagtagtttgattagtaagacagtgtttaaatcatgattacttgttgctctaatattttagactttgaaagatgacaagatgtgatgtaggtgacaaagagcatttttaaaaatgggtgaaattggccgggtgcggtgactcacgcctataatcccagcactttgggaggctgaggcgggcggatcacaaggtcaggaaatcgagaccattctggctaacacggtgaaaccccgtctctactaaaaatacaaaaaaaattacctgggtgtggtagcaggcgcctgtagtcccagctactcgggagactgaggagaatggcatgaacccgggaggcggagcttgcagtgagccgagatcaccctactgcagcctgggcaacagagcaagactccgtctcaaaaaaaaaaaaaaaaaaaaaaaggtgaaatttaggcctatcaagatacttgggatgtaggaaaggaatatatatatatatatatatatatatatatatatatatatatatatattttttttttttttttttttttttttgagacaaagtctcgctctgttgcccaggctggaggctggagtgcagtggcatggtcttggctcacttgaacctccacctccctggttcaagaaattctcctgcctcagcctcctgattagctgggattataggcacccgccaccacgcccgtctaatttttgtatttttagtagagacggggtttcaccatgttggccaggctggtctcgaactcctgacctcagatgatctgcccgcctcggcctcccaaaatactgggattccaggcatgagccactgcgcccggccggatgttacatttattgagtacatattaagtactgctcactgttttaggtacttcctgtgcattgtcttttttaacctttcaactaagctaaatactgttgtccctgttttaaaactgggaaaaatgagcctctgagaggttcactaatacccaagctgacatagtttctaaacagaagacttgggattattactccgatgctcgcttttttgaaactactggtcacagtcgtttgtggttattggctcatctagatcaatcaattggatgaaacccagaaaatagattttgtcttcaacaataccattaaagagttgccttcacattaaaatttaataactacatcttatcctttgtactcttaatcacctgttttccctattttcttttccagatttctgacatgagggattttgtctcatttgctctaaagagtgaacctaaacattgtgtttaggtttgttattagttgctttaaatatatacacatctgtaaacattgaacttttttgatgcctcatctgtgttgcttatagatcattttccatcataattattttaaagtccttttaagaagtttaaggcctatctcatatatgtaatatattaatagtagataatcaggcctttggaagcataaatgatgtaagtaagttgggttgcagttttttcttatcaagaatctgcgtgtgtttaagtggcagtggagataatatttttatttgcgttgttatagtgttatctttatcatttagtttatattttctgccatttaaagataaaaaggttttatcttttatagctatagagtcatcttctgagccttaaaacacttgtgttttttttcttttcgccgtgtgggtggggaaaggggtgtgtggcaatggccctgtgctttgcctctgcctgagttacaggcgtgctttgtttgcctggctggggtttgtgtctcccatgctcaggagggtggaaccagtttcccagggcctgggccctacctattgtcattctccccataaggggatctgttacgtgtacttgtgggaccacacagtgctctgggcagataagcctcttcctgcctatatcagaaccaacatagcccacacacatctgggaaagcatgccagggtcagcaccccaggcgccctgtactcccagcccattccccttcttcttcccactcacctggaatccctgacccaaggctctacctattggttctaatattctggtggacagaatctaagagtccagcaagctcagaatctcaggacctcctcatccctttaggaaccatcaattaatctcatgatttcaggttgaaccactggagtcaatttcagaagttttggtctatctcagaaccttcagatcacactcaaaagcttggggacagcctcagaaccttgggacacatctcagcatacagggtcatcaatcttagaacttgaggtctgtctcagaaccttcatgcgaaactcagaatcttgggaagtcccaggaccttgtgcccggtattataccattggatcaattatcacagtcgcagaatcttgaggtccatcttggaatggtgcagtcagcctgaaccgtgggatcaagttcagggacatgagaacaatctcagaaacttctggccagtcctaggtctgaaaaccttcaaaacagcaacagactcttgcggtccatctcaaaacttgagattgtggtctaaaagggaccctcaagactatccatccagtcccttcctggaatacaagtcacctccacagcctccctgatctcgctgtctagtctttgctatgagccctcctcgatagggatacctggcccctacccactgcctgccttgcttctggatggctccagctactaaatgatgtctccaaaatgtgagaatctgaaatctgtctcctttttcccacatcagccctctgagacctctgcagagatttcaaggcaagacccatatgctcagggtaagctttgtcccagactgcccacactgggttcctcccctgacttccagatctccacccgcccttctgaacactgttatctgcaacacagttacctgtttatgcatttcaattttgagcctataggatatctcatactgcaaaggaaaagcccattgggaatgtctggggtggaggtggatgcccaaccctgtgctgggtgatgctgggggaatcacagcaggatacagagccccagaaccccatggggtcccagaggaggagcccagaggaggaagcgggaccatacctggaggggctgcctctgatctcctcagagactaggggtgcagtgggaggagaagataggagatgcctagagaccctggccccacagagatgcctgtgagaagagggaagattcctgtttcactattctcaagagctgggagaggcttctgagagagaacctgtaatcccagtcggcccaattacagataggaaagataaggctcaaagagggctcagtcctaccccagagtggttgggtgagtcaggactaacaagtcctctttcccattcccctgacatcataactctccccaccatgatgttatgttgctgcatttcagtcttctcactggccatcttctcacattccagcttgacactaactaggaaggagagagaccatgggggtcccacacaccccatatgagccaaagtgaaaaacattgttacttttaatctcatttcttctttgtaaatgattttttgtctctgaaattctgtgacatgaatcagtttagtcactttttatcttattaaatggagagaaaaattgcttaagagatatttaggtgtgttgttttttaaccctttttggttgtaaattgttttctttctttgttttagtaaccccagaaaatctagaagaaaatctagaagagaggtaggcagatcattggtttaaaaaaagaagcccaccaactaaatcttttattgagtaaagtattgtttctaggtagagaaagattagagaattgtattgagaattttactaggtttgggatttacaaagaggctaacatgcaaaaggcagtgctcttcgaaggagtcgtatagatgtggagactttatagcccttagggagatctacagacatccgctatgctgagttctgggaagctgctttttcccatgcttgcagcctccccgtggggtaaaggtctgttagttttgcataaatatttaccatatctcattttagctagcattgcttcctcacactgttagcactaaggagaactttgcttatccagcttgaaaaatttactgtgatcgatatgactaatctggaggatgttctgtcatctttgagcattgatgaagttaaaaagtcagattggcaaaaataatgagggggaaagcaaccggttcacagttgacaaacatttgcccatgcttgttttcccatatttatttttttaaacgagaaggttattacacaagcagcatttcagtcttgtcacacccaataaattattgttgcttttatatgtttatttgtatactagtcgtttacatttgcatttactatacttttacaactgtttccttattttgtaaccatgaacaccagcttctacatgtaaagcctcattctaggtactttatatacatcatatttaatagatataataattgtacaaggcaaatgttattcccattttacagatgagaaaaaaacttagattcaaagacattgattgactagatcagtatttcccagctataaatttttttggaaccaggttttaaattcaagtcttttagcggggcacagtacctgtagtcctagttacttaggaggctgaggtgggaggattgcttgagcccaggagctccaggctgcagtgagctatgattgtgtcagtctacttcagcatgggctacagagtgagactctgtctctttaaaaataaaaaataaaaaaacccagatctttttgactcttgattcattacatttgctactgtacccaattttatgttactccaaatgaaaatattcagccaaagaaggttatttaatctattttaagataaattacaggagtaatttctaagttgtgttacagggaatatccaggacactttaataggagtgtatttttttgactcatgagccctacaacattcaggcattcaaggccaaaggtagaatgtaaaatgatattaaaaggcaaccttcagactttgagtttattattttaaaaaagatccagcttattatggaaaaatggcctaatccattttattagtcaaaaacaatccaacatttgcaatttcatgtgattcaggctaggagcaatctatcagtatgactgcgtcttaaatcttgtcaatatttgataggattctactttaaaatttttgtgtttttgtgtctcttaccttctacttctccttcactccatgtcttttttaaaattttttatgtttttgagaccgagtcttgctctgtctcccaggctggagtgccgtggcatgatcttggctcactgcaatctctgcctcctgggttcaagcgattcttgtggctgagccacccaggtggctaggattacaggtgtgcgccaccacacctggctaatttttttttaagtagagatggggtttcaccatgtttgcccagctagtcttgaactcttggcctcaagtgatctgcctgcctcagcctcccaaaagagctaggattacaggcctgagccactgcgcccagcctccccttatctttttgcatgtacactttgtctttattgtcatcactaagcttttaatctttcctttgttaccccatctaggtcctctgctctccctcaaccttttacttatttctggttgagcccttttgtcattccctgcaattttctgaccatgtagtagatacccagtaggcttcctggattacttggtttttctgtattttgctaaaaagttactccaaagatgataccttctatttggacctttcccaccctttatatacctatctaggaggtagtaacccaaccattaatctctccatgcaaaatacatgtattgactaaaaattatgtgctaggtactgtaatgtttcctacccattattttacttaattctcacaattactctgtgaggtattcacaggtgaagaaagagaaagtttaagtagcatgcctagtgagtggtaaaacttggattttagtatgaatctgtctgacttcccaacctgcactgtttttttttttgttttgttttgttttttttgagacagtcaccctctgttgcccaggctggagtgcagtggcgtgatctcagctcactgcaacctcagcctcctgagtagctgggactgcaggcatgtgccaccgtgcccttctaatttttgtatttttagtagagacggggtttcaccatgttggccgtggctggttttgaattcctgacctcaagtgatccgcctgcctcaacctcccaaagtactgggattacaggtgtgagccaccatgcctggccccagcctgcatgcactcttaaacactatcctatactgccagatatggtcagagttgaatcagatactgtttctgccttttaggaacttcgagtctaatagaggaagatagagaactaagtgcacagggcacagtggagactgaaaggagaaaaatcattactttttggacagatcacagacagcttcatagaggagatgaatatatttgctgaatcctggaatgtgggatgtagttactggacaggtaagggatagaggaacaattcaggtaaaagaaacaatcaggtttttttgagacagagtctcactccatcacccaggctggattgcagtggcatgatcttgcctcattgcaacctccacctcctgggttcaagggattcttgtgcctcggcctcccaaaatactggaattacaagcacgtgccaccgcagctggctaatttctgtatttttagtagagacaaggttttgctgtgttggccaggctgtccttgaactcctgacctcaagtgatccgcccacctcagcctcccaaagtgctgggattacaggcgtaagccaccgtgccaccaaaataaggaatattaataaggacatagaggtgaaatagctcacattttcaggaactgcatatagttcagcatggctagagcatggaggttgatgatggatgggcacagcagttggtaaagttggagtgataggtggtaccagattatggaaggccttttaagtcattctaaggagtttggattttaacctctggattgtagggagccactgaaggccttcagtcagagaggcagtaagcgttatgttataaaagattctttcggtggtagcgtgaagaaaggattagtcttgagcaacagtttcaggggcagagaaaccaatagtgagacatttttcagtaatccatatgaaaaatgatactaataaattcctaaactgaagttgtaacatatacttaaaagcgaagagacaaagttattaagaagatactaagaataccagcagggtgaaaggtgtgtggtcaaagtgtggggctttctgggttgtgtccttgggtaggggttggtaatacttagcaagatagggaatgtaaaagggagaaggcagggttttgttttgttatttttgtttggctgactgataagatggaagatggagaagagaacagacatagtaagggatagatttagtttaagttactaaatctttagtttaagtattcactatctgttgtatgatagattatcccaaaacaataaacttgcactatccactatggtaaccacaagacaaatgtggctatttacatttaaattaattgaaattaaataaaattgaaaattcagttcctcagtgacactagccacatttcaaatattcactagccacatgaagccagtggctacagtactgttggttgatcatagaacgttttaaattattgcaaaaagctcttttggacagtgctgccaaacatttatcaacgcatagtttactaagatcagaaatcggtgagcaactttgctgggtggttctgcttcaaggtttctcatgaggttgcagtccaggtgtctgcaactagaagcaagggcttcaggaatctgaaggctcaactgcacctggtgggtccatttccaaggtgacttactcatgctggtcaagtgagtgctgattgttggtaggaagccctagctcctctgttggtaggtggacttctctgtggggatgtgtgaggcagctggctttgccctgagtgagtgattttagccagagagggaggtagaagccattataacttttgtgagctgacctcaaaagtcacactacatcatttctataatctgttggttacacaggtcagcactattcactgtgggaagaaactatacaagggcatgaataccaagagtcaatggggcccattttgtttttttgagataggatctcactgtgttgctcaggctggggtgcagtggtgtgatcatggctcactgcagcctgaatctcccagcctaaagcagtctctcatctcagcctcccaagtagctgggactacaggcatgccaccatgctcagctaattgtattttatttttatttatttatttatttttggtagagatagggttttgccatgttgcctaggctggcctcaaattcctcggcacaagtgatctgcccaccttggcctcccaaagtgctgggattacaggcataagccaaagtgcccagcctattggtggtcattttggaggcttcccaccacaaatacttacggaatatctgggtacaaatatctagtggacaactaaatgtataggaatgagttcttagctagtgctattatatttgtgatggtagttgaagaaacttgaataggtgtagatcaacaaggatgagattgaaccagaaagacagttaatatagtatcttgggtcacatgtttggggaggacagaagtactttcaaaggctggaggaacagctacaggggagtagtagtagaacaggcaggggagtacattataaaggaaacttgaagggatgaaagttgaaagtagaatgtaattaacattgttcagtagttaaataagagtaaaacttaacagagtcattctttcaaaaaatatttcttgaatacctgtgtggggaaccagagaaagattggtagataaataagaccaagtctctaataacacgtaatactatctgaggagacaagtttgggaaggtttcttggaggaaggtaatattttaaggtagagactctttaaagggtaaggaggtgagttgggtattttaggggtgtggtggtagagatatggatactaaagtggacatttcaggctatgttagatgtggaacactgctaggatatgaagttttgtgatgagggaaagtggtgagaaaagaggctggaaggccaattagagtagtcttgaatacatgcatgttaaggaacttgcctttatcctgctgactgtttcccatacttaaatttggatactactttagtgatttgccataggcttataacccctaaactgtaagttactaaacatttttctttaatattactctttattattttatttatttattttgagacaaggtctcactctgtcactcaggctggagtgcagtgatgcggtcatggctcgctgcagccttgacctcccaggctctagtgatcctcccacctcagcctcccaagtagctgggaccataagtgcataccaccacattggataatttttgtattttttgtagagatgaggtttcaccatgttgccccaggctggtcttgaactcctaggctcaagcgatccgcctacctcggcttcccaaagtgctgggaattcaggcgtgagccaccatgcctggccagtaatattactttttaaacttagaaaccatttccagagggaacttcattgtattgttataaatagaaaaccagtattgtttgctacatataaaagagaatagaaaaaatatgaatgattattacgttaaaaaaattaaaagtggaatgtagcaatgcatcctttgatatagaaaaatgcccacttggaaataagttcctcagtgagaatactatttttggtcagttagcaataaaagggcctttgcttgaatagtgtttggtttctacctaagatgagattttaaggtcattaagacaattccatttttaaattttgatgttaataagcaccaagaatcacaactctcaagtctgcgtacttggaaagatcataatacagttaatggtcaactttgtccaactttattgttaattcaagcactaataaaaattaagcccttttgttccaagaagccatctaaagtagtttatagcaggggtccccaacccctgggccagggctgcacagcaggaggtgagctgccagggcgaaagagcattactgcctgagctccacctcctgtcagattgctggggacgcattagattctcataggagtgcgaaccctgttgtgaactgcacatgtgagggatctaggctgcacactccttaagagaatctaatgcccgatgatctgaggtggaacagtttcatactgaaaccgtacgtacactcaaatccccatctgtggaaaaattgtcttccactaaatccgtccctggtgccaaaaaggttggggtctgctcatctatagaatctattcttctgagtgtgtcaagttatttattggacatctggaaatggagaagggattttttttgtctactctttgctgccatccagtttgggaaaattctcgcaaaaattttcaaaaatttcaagcatcttttacaattttcgaaatatttccagtgagtttttcagaggaatccttaactggtcctttcagagaggaaaaaagtatccagctcacctacatatctcatagttctagtttcacatttatcttgttcactttgttttgtacgtggaatacgtaaacttgtcaggataaatttaggttgttcacataagtagatatatttgtcaagatatgcttatttgcagagcctgtctcaggcatgcacatgatctcacaaactgaagatttcttccagaaatatttgaaatttttcctgcagctcaaaaggatgcatgaagagttttccactctttttgccaaactctatatgtagccccaattttgaagttacttttataaggttttaaataaatggttttgaactgtaatgactaacaaaaggcatgtgaatgatagtgctagagatgctgccaccaaagtaccaagaaagaatatcatgcttgatgataaaataaaagctttggagtgtctcaaattggctgaatacatttaatgagctattagaggaaacatggtaaagatggatggtcatttagaaattctaaagtcctgtaatgttgaggaagctaaacattatcaaatcttggaagaagtaatcaatataggaagaagaaggaggagaagcaatactttggatactaagcaatagtttcaatactaagttgaaattacttagctaacctcaatttaatggactcactacatttcctctgcagaacatgacttttacccagtgagttaaatgcttgtgtctcatggctattttgtagtgtgtctgaatgcttctacttcgtccagttgaattgtataatctcaacccgttgtacttgaattggaattagatgatttagttaaatattatgaaaactgaaaactgatgaaatctgagcaccaaaaagaaagttatttctataaacagtgagttgtgtgtgctttggaaataagagtagagacttgtcactgaaaaaaaattctgtcaaattagacgtgtatacaaaacaattattatttggaaagtatcttctagattattatgaatgtctttcgtttcttgctccactctaaggaaacaggaaataaatcatagctgatatattttaggacagtttataccagaaagctgatgggacactccaatcaacagacccctacttaaagaaacagccaggcgcagtggctcatgcctgtaatcccagcagtttgggaggccgaggcgggcggatcatgaggtcaggagatcgagaccatcctgactaacacagtgaaaccccatctctactaaaaataaaaaaaattagccgggcgtggtggcaggcgcctgtagtcccagctacttgggaggctgaggcaggagaatggcgtgaactcgggaggcagagcttgcagtgagctgagatcgcaccactgcactccagccttggcaacagagcgagactccgtctcaaaaaataaaaaaagaaaaaaggaaaaggctttgatcctacattttaaaattggcaaatgaatgtacatttacataagttgaaataaagtttaaggtttgtatgaatggtttttaattatttcctgctttaactattcttttccattaaatgaccaaccactggtaccagtggattggataagacagttggcactgcgtggataaaggaggtttaaagaaaaggaaacatgaaatgccttctttttgaggctgctacaataaccaagttacaagtgtgctgattaatttattattcctgtttccagaaatgtcttatttgtatttcatttttaatatttttaaatttaatagtttacatttcccccactagtgttgccttctatttgtagcaagttaatactggttttctatttataatagtgagataaagtttcctttggaaaggaatgttacctttaaagaaaaacattaggtgactaataatttggtgcttatgtgactgtggcaaatcatgaagatagtattttaagtatggaaaacaattgctaaccagcaagataatgtcaagttccttaatatgaactcacttcttggcctttgtctaccttctccagcttcatgtcttaccactttcccttattatggacttcatgttgatcaagtggaggctccctctcctcaaggagagtccctaggccagattcagaagatggttggtagagaggggatttgatagcttctgaggacagtgctttggatggagaaatatcatgcaacttaggacagtgctttggatggaggaatatcatggaactttagttttccagctttattgagctttgcctgtgatattcacttgtttggggggctgtttggagacagggtctcactacattgtccagacacaatcaccatgtactgcagccttgaagtcctgggcttaagtgatcctcccatttcagcctcccaactagctggaactacaggctcgagccactgtgcctgactcttactcacttttttgttcccaatacctggaagaagatcgtcagtctgtaaatatttgaaatctaaataagggttatggtgctgtagtataaggccaaatcttgggcaccaaacaaaaaaaaatttagaaaaatcccttagcccatcccatgctgtgctgggagcttcatctttctttttaattgcaatttaaacgatctactgctacaagagggttgtggtaaagcagaatttcttatactgtgcaggtgggcatgtaaattggtttaaacttacagaaaataatttgacaatatagttcaaaagcctaagaaatgtttaaactttttgaattagtaatgccaattttggtatatatctcaagacattaaggatatacagttttagctgtcattttatacaaagagatcacccacaccattattttagtaggggcaaagaggaaccaatgtaagtctggtgcctctgaagaggtagacctagaaactgggatgacaaggaactcccaggggactgctgttaataaattactttatgtcatttgataaaatatatgtaagcattaaagacattttcaagtaaaccttagtgaggaaattgttcatgatctgtgaaaagtatgggataaaacttcaaatataatgccagttacatttttaaaaaacattcatgtgatgcttttaaaaagacttctaggacatgtaccaattttttttttttttttttttgagccaagtcccactttgtcgcctaggcttgagtgcagtgggcacaatcacagctcactgtagcctcagcctctcaagtagctgatactacaggcacacaccaccatgctcagctaattttttaattttgtgtagagacaagctctcactatgttgcccaggctggtctcgaacttctggactcaagtgattctcccacattggcctcccgaaatggtgggattataggcacgagccactgaacctggcatgtactactttttaagtgtttctgggttgtgagattatagatgaattttgttttattcttcacactcatatgttgttttctaggcttttaactatgtgtatatatatatattgcctttgtcatgagagacacttttgtttttaagtgaaacctctgtttagtttttatttatttatttgatctttattttaatggaaaggtaactgtgctggtaagctgatagatgattggaaggaataattcttgagactaggaatgcaaatgaaagactgctgggagatatgagaagctcctgaactagggcagtggtgataggattggagaggaatatcgtgatcagtaagacataggaataaaggaaaaagagggatccaggatgactcccaagtttctgggtgtttaaatgtaatacatttgagatgaaagtttggctcttaaaaaatattcttatttggggaatgtttaaatttagtgaggtcattaacaacttcagattccttttatacttcaattctttaaattctatatgttgccaaagatcctacttctaatttgttagggttaacaagaagaaagatgatatgtctgtgaagacatgtttctgacatctgtcaccctatggattgccagttgatagacctggttgtcttgataagtattagctgactccccaaccagtttatttgcaccacttctgaagcaataagcttggttgaaaaagggcacctcccaagtagggaaggataatttttaggtcaaattatagaaattgcatgtatccctgttaacacttccaacaccaacaaaaaaatagacaggaaaatgaccctaccagctaattctccattataagactttgaagaaaaggttccattaaaaacagaaaagaggctgggcatggtggctcatacctgtaatcttaacactttggaaggccaaggtgggagaattgcctgagttcaggagtttgacaccagcctgggcaacataacaagaccctgtctctacagtaagtaaaaaattactggatgtggtggcatatgcctgtggggccagctgtttgggaggctgaggtggaaggattgcttgagcccaggagtatcaggctgcagtaagccatgattgtgctattgcactccagcttggtgacagagtgagaccctgtctcaaaaaaataaaaccttgaggacccaaatttgatttaaatttagatgtactatctgctttgggagagttactttattattatttagtagagacagggtctcactatgttgcccaggctggtctccaacttctggccccaagcagtcctcccaccttgggctcccaaagtgctggggttacaggcgtgagccaccaaccctgcccttaagttatttttttgatcttttcatgacatgctgtgggcaataaaataatacagtgggtgatctgttgttgcaattcaaatatggagttcctttttcttccacaaaagtattggctgatttctttctttttctggctgtgagcaacaggtaaattaacatgaccatggtctgtccccagcgtcttgactcagatttcttaatttgaacttttccatcttctccactccaagatcacatgacaacatccaacatcagtggatagaaataattagaggctggatgaggtggctcacgcctgtaatctcagcactttgagaggccgaggtgggcggatcatttgaggtctggagttcaagaccagcctggctaacatggcgaaaccccatctctaccaaaaatataaaaaattagctgggcgtggtggcacacgcctgcaatcccagctacttgggaggctgaggcaggagaattgcttgaacctgagaggcggaggttgcagtgagccgagattgtgtcactgcactccagcctgggtgacagagtgagactccatctaaaaaaaaaaaagaaatttaataagtcactgctacactggcaaagaagggttgagtagttttaagaagcttagttgctgtccaacagtcttattgcatctgattcttttggtgcttgcttactcaagtagggatcacatagcatgggaaggaaagagcagatctgtgattctgttgtttacatctcagaattgtggtttgtgaatagttttgaaatttttcttatagttttgggagaaatttgttaacggaatttttaaggattataggacagcacaaaataatttctcttgtttagatgcttttaataataaaaaaaatctgttaggatactttttccttttttttttttttttttttttttttttttgaggtggagtctcgctctgtcgcccaggctggagtacagtggtgtgatcttggctcactgcaacctccgcctcctgggttcaagcgattctcctgccttagccttctgagtagctgggattacaggcgcatgccaccatgtccggctaatttttgtatttttagtagagatggggtttcaccatgttggtcaggctggtctcaaactcctgacctcatgatctgcccaccttggcctcccaaagtgctgggattacaggcgtgagccaccacgcccagcctagaatactgtttaaatgataaaatagctgagtgcagtggttcatgcctgtaatcccaacactttgggaggctgaggcaggaggattgcttaaggtcaggtgtttgagactagccctggcaacgtagtgagaccctgtctctacaaagtaatttcaaaattggctgagagtggtggcacacacctgtagttccagctgtttgagaggctgagttgggaggattgcttgagcctgggaggttgaggaggttgaagctgcagtgagctgtgatcgtgccactgcaccccagcctgggtgacagagcaagacctcgtctcaaaaataaataaataaaagataaaataagaccgaaagatttcattatgggatagagaagaaaactaatatggaatttaagataatattcttatatttgagtggcctctttttttgagacagggtctcactcttattgctttggctgggccacagcggcatgatcttggctcactgcagcctggacctcctgggctcaagcaatcctcccgcctcattgtccatactgtctagctatctccatgataacaacatcatcttatatcatgactactgactaaaatccttagtagctgggactacaggcacatgctacaatgtctggctaattttttaattcgtttatagagatgggggtctccctatgttgccgaggctggtctcaaactccaggcctcaagagatcctcccaccttggcctcccaaagtgctgggattacagacgtgagccaccatgcctgacctgagtagcctttttatttaaagggaatcggcatttgtttattacctggtatgttctgagtatcaggctgtgtacttaacctcacttaatcctgacagcattcctataaagcagatacctaacaattatttgtgaggaaattaaggttcagtgactttccataaatttgcttatggtcacacaatccattgagtgcttgtgccaggttttaatctcagtctgaccaataccaaaactcattttttctatgtatgtttcccttttagaaagattttatttttttaattttaattttaattttttaacttttaggttcggggtacatgtgcaggtttgttatatcagtaaactcttgtcatgggggtttgttgtacagattattttgtcacccagttactaagcctagtacccaaaagttattttttctgccccctccctcctttcaccctccaccctcaaataggccccagtgtctattgttccctagaaagatttcataagtaaatgtcatctagcctgtaaattatttttgtttgccagcatttataatataggtggtcattctttaggtgctgaaacagaattggttttgtccttagtgtctggctgtctccaatgataacaacatcgtcttttatcatgactgctgactaaagtactatattctcaaatcttcttttcttctttttttttttttttttttctgtgacagggtcttactctgtcccccagtctggagtgcagtggcatgatctcagctcactgtagcctctgcctccagggttcaagtaattctcccacctcagcctcccgagtagctgggactacaggcgcacacccgcacaactggctaatttttatatgtttagtagagacggggtttcaccatgttggccaggctggtcttgaactcctgacctcaagtaatctgcctgccttggcctcccaaagtgctgggattacaggcatgagccatcccactcggccagatcttttgtttttaattgaaaacttataatacatttcagagataaaggagagctatttcagaactggtgcttattggtaagttttaaagagttaaagtcagtgaactggtggtataagccatttaatcattatgtttatcattttatagatactaatcggagtaatgcagtttcaacaaaagtagtttattttggggtatacaagaatttttattctttaagctaattaattctaaatttaaaagaaggaaaacacctgagaagcttgcgctcttagtgttactacacagaagtctcaatgtagctgcaacatctgattttaaaattttcttttttcgtcttatacttggaatatttcacaataaagtaaaaagaaaatgatatacatccatgtacctgctacttagtgttatctttttgggggacgaggcaagcaaataaaaattagagatgaagtcgaggctcccctgggtattttcccccgatcctgttctcttctgcccctttccagaagtaaacatcatagtaaacttggtgtttgttgctcctatgcatgtttttatactttggctatatgttatgtatcttcaaacattatggaaatttttgcagatttttaaacttcctaacatttgaattcatgttctatattcagcaatgtgtttattaacaaaatatcaataaaaattactaattataactgttactattaataatgaatattaataaaatattatgaatatgatatgaggtagggattgagttttattctttcatgtggagaatcagtcgtctagccccattcactgtgcagtctgtcttttccctactgatgggtagcactatccttgtcatacataatgtttccattatttgtaggtttgtttctgagctttctaatcttttcccttggtttgactatttctgtaccgacaccaaactgttcagattactttagcttcataagcaaagtaaatctccttaccttgtttttcttcttcaaaattttcatcgctattcttagctttttctttttccatatgaattttgggatcagcttgtcaggttcccttaaaagttttatttttttttaacattgtaattgcattgaatatttagtttagtttggagaaaataggcatatttatgatattgtcttcctatacatgaacgtggtttttccttagaaattccagatattcccttatggtcttcaatagtaatttataattgtatccaaaagtcttaaaacttttttggctaagcttatttctaggtactttatgattttctctgcttttagaatggttggtcagtctctttctttccctctcctcctccctcacttattcttttccttcctgtttcttccttcccatcccccattccaacctcctttcattttttttttctctctccttccctcccttatcaccttttaattttatattgttttggctgacagttctatttaaggtagtgtgttatagagaaaagtatatggaacttagagtcaaaattgctggaaatgagtccccgcttcgtccttcaagaattatatgataattaagtcaacttttctgagcctaattctcttaatctgtaaaaggagaatatttacttttatactgtctacctcacagaatcaagtgagatatgtgcatgaggttttttcctaattaaaaattcagtgctaaaaagagttctttctaggggaaaaaaatgccaatttcccccaactaaaagtatagacatttattaaaactgtatctttagggctgggtgcggtggctcatgcctgtaatcccagcaatatgggaggccgaggcgggcggatcacctgaggttgggagtttgagaccagcctgaccaacatggagaaaccctgtctctcctaaaaatacagaattagctgggtgtgctggcgcatgcctgtaatcccagctactcgggaggctgaggcaggagaattgcttgagcccgggaggtggaggttgctgtgagctgagatcgtgccactgcactccagcctggtaacaagagcgaacctccgtctcaaaaaacaaaaaactgtctttaaagaagaataccttaatacataaacttattattttgactcttaaagattataacccttataccccacttcctaaaaaaggatgtgaaatggtttaaagggcacgtaaacatacactcacctcagttaaagatgttaaaaatagaaaatcaagttattacagtgagatcagtgcaaatatgataattatgagggctaatacagccattgtaattaagcctctctgctttcaggattctgtgggaataaggtaaatatgatttggttctattgttggatgtatttcctcctttgagacaaacctaattttactcccattaaattaaaaaaatactgtccaccaaggtttcaagacaatattgggaacaatatctgctacaacagtttcataagtgaaagagcactttttcaaatggttttttgaatgaccgttactaaaaatctgaggggaaaacagaaagcagcactcaccaaaactgatttctttggaaaaactaaaccaaggttatttagatagcttatgatctaatttgtcaggcactgagctggtttataacctagagcagtgatgctttcaacatttttgtgttaacacatatgaacttttgaatactaaaatttttggtaatatgttgaaacttccaagggaacattagataaagtaatagtaactataaggtaaccactagtacagtaaaaatgccttctagttacaaatgaatccaaagcaatctctattttacttaacactattaagcactgcagtctgagtttgattagaactgtttactctctgatctcctctgatcttttttttttaattcaggaaccaaaatatttatatgttctaatatagatataccatctttaacattggcttgaaattatgtaatgcctctggattgtagttatttgtgcttcactataccctgtcatatactggcccagtacaaagttctttctgacaagcctttctaccagtgtgttattaactagtttgctttgtataatgcagttctgctctcaaatacatctaggcaagtaaccaaaggaatcctaggttaactttctgcatttgaaagatgtatttatggaagactgaagcttattttttatatggtaaggcaggtgctcagtttttatggggctttttttccctataatttttcaactttttgtaaaaagcagacaggatttatgataagataggcctgagttcagatccaggctctaccatttgttagctgaacaaccttggaaaagttatatagcttctctaccttagcttttgtctctttatccccaatatctcttatcatgtctacttcataggacttcagatgtgaagtttttaaaaattatcaaactgtaacttattgataattttctgcttaaggtcactctaactgaggaacctacccctagaattaaaaataaatgcacaaaataagctattaataataaatgttgaaaaaagctattccgtattaccagtataatctaaactgaaacaagattttttcttagaagtaattttttctaagtataacaatgctttaaaataaccattatataaaatttctgacatagataaaaattagaatagcttaatgaaccttcactgacctgttaccagctttagtaataaaatacagtttagattaatccttttcaaccatataagatataaagtgacaaggcccctcccctctcccagttgtttaatatgatttacctgaggtagccaccattaacttcctttacacaaatgaaatcaccccataggtgctgttttgtagcttgacattttcatttaacaatatactttttaaaatatgttttatttccatgtgagtacctatgttctgtggctatacaacattctgttctctacaatgttctatataatattatggcagcaaaacacaaaagagtgaaatgagggatgtttgttttatccactgctgtgttcccaacacctagaacagtgcctgcacataatagatgctcaatacatatttggtgaatgaattaacatctagttaggaaatgtatttctaacttggaaatgtatttctattattggtacgatattctattatataattgtataatgatttatttaactagtagaataatgatggatggtaggactttgggtttttttcacctttctatgtttttttcccccttctatgtttttttcccccatattctcttcagggagcaactattatcttgataatggtggcaatttaagaaactactttgagaaaataattaaaatatgaaaaatggattttttgtttttgtttttgagacggagtttcgctcttgttgcctgggctggagtgcaatggcgcgatctcggctcaccacaacctctgcctccaggtttcaagtgattcccctgcctcagcttcctgagtagctgggattacaggcatgcaccaccacgcccggctaattttgtatttttagtagagacaaggtttctccgtgttagtcaggttgggctcgaactcccgacctcaggtgatccgcccgccttggcctgccaaagtgctgggattacaggcgtgagccaccgcacccggccaaaaaatgtatttttatggacacccatagctaaatgtctttccatctagtggctggttaaccaagcatggttcctcctgtttcctttccctatgatcatttcagagtataaccattgtttagtgtaggagagatgttatgacttttagatatgctttttttcataaaaaggaattgcctagttagaattttttaaagatatctcacagttcagcagttttgacattgctggggaaattttatccagggatacagaagaaacgttcattcatttttatttaagcacctataaaaagtaggggggtacttctggcaatacagttgggttactgtttgtggctaaatatgtgtgtgaacattacgacatttgatgaaaacagcttcattgagctactgagctctccagctgatttttcttcttggccttaaaggtttacaaggctaagaatcaatctcctctggggtagatggccttacggattttaaatatgtgttgtgataaaagtgattttactctaatacagcatagtacaagttaacttccagtatgcagaattgacctcgtgaattttagtttaatgatctcagttctcatgaacttgcaaacatagaaaaaaaataaatatttttaaaaaacttttctttttaaattgtgaaaaacgtatatgatggttacagcaaagattatgcttttatgactaattcattacattgagtcatacatattaatgattcaaattactaacatagctctattaaattaaatctaccatacagtatacaggtattctgtactttgaaatttcataaatttttggatatcaactctcagaagggtatactagtaatttgcttttacccacaaaatcttcagatttgtcaacaaaatgaacgagattggtattttcactttagtttctcagtgaaaataaagaatgggtagatgaatggtccaaagagctaagagagaagacttaatttaaactcaaataaacatgcccagaatgaccctctctttttctgcccttcctcctgccacagttagccactgtatgtctcaggttttaggcaaagtgagtcttcttatcatggaaactgtgaacattcattaacaactggttttactttgaaacttaaacagcaaacaccaaagagtgaattgttggtataatccatgggagtcttgagattgacgtcagaacaccagtacagctgtataagcattgggaagtatttttaacatccgtgttagatcatctttttgacctttccttttatgttttctctttttccattaaatggttaaaaaaaagagctttacaatattttctaccaacactgtaatgatattcttaaaaaaagcacccgtacaattattttctttgttcctttcccctttgcaactttcctttacctgtagtgttccaagttctgatggggtggcctttttttttttttttaaataaaaagtttgtttttgagaacagggctagatttgccgaaaatgagaagctagaaaataacatataccccataggcatgctcagagtcccctattattaacatattacatttgtgtggtacatttgttactgaaccagtgttaacattaatattaattaaagtctgtagtttattcagatttccttagtttttacctattgttctttttctttcctcagaaaccacattatatttagtttgtcatgttccttagcctcctcttggctgtgacagtttctcagatttttcttgttcttgatggttttgacagttcaaatgagtactggtcaggtttcttgtaggatgcccctatattagaatttgcttgatgtttttcttacgatttgactggagtatgggttgttggaaggaagatcacagaggtaaagtgacatcttcatcaactcatgccaagggtacttaccgctaacatgatatgtgactattgatgatgaccttgatcaccaaaataatgtttatcagatttctccagtgtaaagtattggaatgttctggtaggcatatcctagttaggttaattgctctggtaattgcttgggctttagttattaaataaatcatcatattggtatactgctcattgaaatgttaaatttttttttttacaaataatgtgttcagagttgagaattagattttttaaatgttcagattgtattttcaaattgtatttttgaaataaagctttcctttcctgtcgaattctaaagattttgtttatctaagggaacaacttaggttcgtattttaagtaggaagttagagagcctggtcagtttatctgcaatttaaattctagacactgagacttatttccttcattttatcttttaaaaaatagactgagatataatttacatataaaattcaccattatattattgttaatttttatgggcataagtatttatatttatggattacatgcaatattttgagacagggatacaatgcatgataatcacactaaggtaaatggggtatctattacctcaagcatttattctttctttatgttacaaacattccaattatactcttctagttatttttaaatgtacaataaattatggttgactgtaatcactctgttatatcaaatactagatcttattctatcgaactatatttttgtatcctttaacaatcccaacttccccaaccccccactacccttcccagcctctggtaaacatctttctatctccgtgagttcagatgttttaatttttagctcccacaaatgaatgagagcatgtgaagtttgtctttcggtgtctggcctatttcacttaacataatgaccttcagttctatttatattgtggcaagtgacgggatctcattgttttatatagctgaataatactccattgtgtatatgtaccgcattttctttatccatttgtctgttgatagacacttaggttgtttccaaatcttggctattgtgaatagtgcatcaataaagataggagtgcaggcctctttgatatactgacttccttaagttcactcattttaagtgtgtacttcgatgagctttgacaagtgtgtatactttttaaccaccacaaccagcatagttaagatatataacatttccatcaccccaaaaaattgtctctgctttctgtcacaatagttttgccttttctacttcatgtaaatgaaatcatgtacagtatgtaatctttctgtgtctgtcttctctgtctctttttttttttaaagacagtctctgtttcccaggctggctggagtacagtggcgcaaacacagttcacttcaggcttaatatcctgggctcaagtgatcctcccacctcatgctcccaagtagctgagaccacacaggtgcacagcaccacacctagctaattttttagtattttgtagagatggggtctttctgtgttgcccaggctggcctcaaactcctgggctcaagtgccctgacccctgcgaagtgctgggattacaggcatgagccactatgcccagcctttcttctctttttttaggcttaatacttttcagatgcatccaaattgtttcatataatggtagtttgttcctttttcttaccataatagtattacattgtgtgaataagtcagtttctttatccattgacctgttggtggaggtttggattgtttccagtttttggctattttgaataaatctgaacattttcctgtaagtttttgtgtggcatatatttttctttctctttggtaaacatctcagagtagaattgctgagtcatatggtaaatatatattaacttttaaaaaattcttttatttatttttttagagatggggtctcactatgttgtccaggctggtcttggatcagccttggttagggatcctcccacctcaccctcccaaagtgctgggattacaggcatgagccaccacacctggccttgattaactttataagaaactgccaaattgttttccaaagtgcctctgtcattttacattcccactagaaatgtcgaagagttttacttgttctacatcctcatcaacacttggtagtatcagtctttttaattttagtcattgtagtgggtgtgaatggcatctcactctactttttatttgcatttctctaatgatgaatgatattgaggacttttcatttgcttattgaccttttgttctcttttgtgaagtgtctgttcaagtcttttaagaagttggcttgtctttgtcttattgagaggtaaggtatgggtcctttgtcagttacatttagaaaatgtttttctttctgtttgtggcttgtccttttatttccttaacaatgtctttcaaagagcataagttattaattttgatgaagttcagtctatcaactttttattttgtattcatgcttcttggtccctatcgtaaatatcttgacttaacccaaggttgcagaaaatgtcctcttaattttttctagaagttgtatagtttagctcttatgtttaggcctatgattcatatcaagttaacatttgtatatggtgtgaggtaaggattaaagtttgtgcgtgttttggcatgttttccagcaccatttgcagaaaagactgtccttttcccgttgaactgctttggcatctgtgttaaaaacttaatagactgtctgtgcatagttgtatttatggtttctttattatgttctgttgatcaatatgcctgaacatattgattgatttattaccttagctttaagtctttaaataaggtaatataagtcttccaattttgttgttttcctaaaaattgttttggctcttctagatctttgcatttccatatgaatgttagagtcagcatgtcaatttctatttacagaaaacaggctgagattttgtggttgtgttgaatctggatcagaatgtggagaattgacatcttaaattaggtctcccaatccattggcataatctttctctccattaatttagtagtcttctttaatttctctataaacattacatagttttcagcatacagggtttgcacatggtttgttaagtttatgtgttttgaggttataaatagcatttaaaattaatttttaattctttattaataatatatagaaatacaattgatttttctatgttcatcttacatactgttactaaacttgctttttggtgctttttttatatagatctctggagttttccataatgtcatgttattaaaaagttttactttcatttaaaagatgtaagccttttatatatttattttcactgtcttactcatttggctgaaatgttaaaagaagtggtgaaagcagacatgtagacatcttttcattgttctcaatcttatggaaagcattcagtattttaccattaagtacgattttttttttttccatactctatcagtttggggaagttaccttctattcctagcttgtaagaaattttataattaacagatattgaatttagtcatatgctgtttctgtatctgtttagatgatcatatggcttttctgttttctttcttttttttgacttgccaggaggtattttcatctgaggcttttctttcttagactggtgatacagtgaattacattgatttttgagtgttaaacctacctggcattcttaggataaaccccatttggtttatcctaatggtctctttattatgtattatgtattattctttttatttattgatagatttggtttactaatattttgatgattgttcttgttcctttgttcctaagggatatttgtgtttagttttcttgtaatgtcattgccttgttttgatactgagacagtgttggcctcagaaaattttttgggaagtgtcatgtgttttcactttcatttgtcagatgtagaattgttatctcttcctttaaatgcttgtgataattcaccagtgaagtgagttttctttgtggaaatgttttcaaccagcaattaaattcactgccccctgagagtacccactattctgacttctagtaccatagactaatccttaaactttttttggattaattttttatttagagaaaagttgcataaataacacagaaaattcacgtagagttcccatataccctacacctagttttcctgattgctgacatcttacattattgtggtatatctgtgaaaactaagaaaccaaccttagtacatactgttaactaaacttcatacttcatttggatttttccagctttttcattaatggcctctttctgttctaggatcaaatttaggataccacattgcctgtagttttcatgtttccccagtctcttggtttgtgacagtttctcagtttttccttgtttgtcacgaccttgccatccccgaggactttgtagaatgccccccagtctgcgtttgctgctgttgctcggtattagactgggttatgcgtttttggaaagaatcctcttttcctctcatcaggggtgcatgatgtccacgtggcatcactggtgatgttaaccatgaccacttggttaagatagtgtttgctaggtttcttcactatactctgttttttgggaacacattactaagtccaacccacactttaggaagggggagatatctacatacatggtttgaaattcttctgtaaggaagatttggatctttccccacatttatctgtttattcagtcatttatatcagtatggactcatgtatgtttattttatactttgagttctaatgctaggtttcttttcttttgcttaaattgttccaactttggctattgggaaggttttccggttactgtttatgtccctttcatatgcccctatccttttgttttttgaacatctcctgacgtggtactagaagatgctccaggctcatcttgtattttctttgcatcagctgtagaatcagccatttgaaggaactagcattccttttatttaggaaccaaaatgtagttactaggtgtgctcattgctattggagtatcgttgcttttaggccctctcaggggacagagctaggtaatatctgtgtgaatactaacccatgtatacacatacatctctaattgtttctatatgtatcagttggcatatatgttaagttaaacatgagttgatattgatgtctctgattataatccattaccacaaggttcactctagtcctcctttttaatctgtgacttccttgtctgaccataagaaacctggctccagccaccccattatccatccacttattttttcaacctatgtacacatgaaaagcaaatttagaattattaccccataccccatgagtacagtatttatgtacagtttcttttgtcattagccttacaatttcaagtcaaaacaccgtgttccaaagtttgttaggtaagctcctttttcaccgccccttcagtgaagttatgtcatacatttgtaatgcagttagtttcatttgtcgcaatccacatttcatcttgggatcctctgacgttttggttgatgttagtggttgttgtttggttaacatttgttgaagttcactctttgtactgtgccattctgtgggttcagacaaatgcaacgggtcatgtattcaccaccctaatgtacagcgcagatcctgcaccctaaatgtccccctgtgcatcccgtttgtagtcaaacactctcctctcctctagtccctagcaactactaatttattttctgtgtctctacttttgcattttccagagtgttgtataaatggaatgatacagtctttggatttttccatgtagtaaaatacatgaaaaatccaaagattgtatcgggcttctttcatgtagtaaaatgtatttaagattcatccatgttgtgtaaattaatagttcatttgttttaaaaattgttgtactattccattgtgtggatgaatcataatttgttttttcattcccccattaaaggccattgtagttactttcagtttttggcattaggagtaaagctgctgtaaatgtccatggccaggtttttgcatggatataagttttcaagtcccttgtgtaaatacctaagagtatgattgtaggtcgtatggtaactctgtgtttaactttcgactgcttttgttctttatagaaatggagttgtgcagtatgtgctcctttttaatctagcatctttcttttgaattgtttatgacatttatctgtatattttgagtggtcataattcatttgcattattgattaatattctaatgtgtgaataaactacagttttaaaaatccattctactgcagatggacatttagatagctctagtttgggactgttactaacagtgctgtttaggaaccttcacagacatgtatttttgtgaacatacatatacatttctgcctagttgtggaattcgctggtacagctttagctgattgtaccaagtaattttctggagtgattgtaccaatttatagtctgatcagcggatgtagtttctaggtgcttaatgtcttcatgagtactgtatgtattcattcattctatttctctctctctctcattgtggttttaatttacatttccttaaagttgagcacctttttatatgtgcattggttatttggatattcagaaaaattaagaaaattgtaaatttcttctgggctctgaaagcattggggtttggaataaggggtggcttccattaggaaaggcagtaagggggccgggcgaggcggttcacgcctgtaatcccagcactttgggggccgaggtgggcagatcacgaggtcaggagattgagaccatcctggctaacatggtgaaaccccatttctactaaaaatacaaaaaattagccaggcgtggtggcgggcgcctgtggtcccagctgcttgggaggctgaggcaggggaatggcgcgaacccaggaggcggagcttgcagtgagcggagatcgcaccactgcactccagcctgggcgacagagccagactccgtctcaaaaaaaaaagagaaacagtgtctttgggggagagccaggtgttggtgaaggcagcgtttggagtgcattctgtgaagaagttaagagtgtagtggtgtttggtttcttgtagcaagagtcctagagcagtggtccccaacttttttggcaccagggaccggttttgttgtagacagtttttcaatgggactgggagggtgttcgggggagggcagtagtgggatggtttcagggtgattcaagcacattacatttattgtctaccttattttcattattattacattgtaatgtataatgaaataattatatactcaccataatgtagaatcagtgggaaccctgagtttgttttcttgcaacttgacggtcccatctgtgggtgatgggaaacaatgacagatcatcaagcattagattttcataaggagtgtgcaacctagatccctctcatgtgcagttcgctatagggttcctgctcctctgagcatctaatgctgccactgatctgacagaagtggggctcaggtggtaatgcgagtgatggggagcagctgtaaatacagctgaagcttcacttgctcacctcctgctgtgtggcctggttcctaacagatcatggaccagtattgtctgtggcccaggagttggagacccctgtcctagagtacacagtgaaaaagtttgatagagaggggaacagtggaagattttgttagatatgtcacatgattaatggatgactaaagttttgtttggtgatctaggatgatagagatgttgagacatgaaattagttggcttcaagttctaagctgtcctgtgtgagaaattgcctcatcagccaacacaggctttgacatatgggtagcttcgtgtttcttaggatacttgggctggtcagaaagtgccaagcatcagagaaactgagacctcggtataggtggaggaagtctaatgatagccacagtcagtagcctagtctgatttgtttttagcaaatctagactattttcttaatcagtaactacttctttagtaactacttacaaggcgactgcctttgccaaggtatatgttctctgaaagctgattcttcatagatcactaactgtagttttgaggttctgtgatttccttcaaaattcacagaaccttgagctataatttatgtggatagagtgattactgggatttaacttaaaattagatgtattcaaatgttttaaggaatatgttttgtaaaacaacatgtttttcattcgttacttatatattgatcccagaaattgtgtgcctgcaaattgtcaagttgggttgatgcttcagaaaaggaaagtagaggctgagtcttcttagtatagcaatgcattttttagagcagtgtttgaggcaaattattttcgcaaaattacatggcttctagggattagattgcatgagtttgtctcttgttcctccctcattctactgtaagaggccaggctgctagttaacagaatgccagacataatgcctagggcatagtttgagacctgggaagattcacaataatcaaacacaaacagacagagtagcatgaagaaatttcaatcctcccagtcttgcttacagatttaattaggcttattggggcagaaaatatttttcctccccccatgtttaaatctgtttctcctctactcccacctcctgtcccagattctctttgaaggggtaatactagcaacaaaaggagatttttttttttttttttgtaaatcctaacttatttggtttatctggctttaggaaaaggagcagtaacaacaaccgaattttaaggtatttgagggactccattttttggcactgtatttgggaaattcccaatttaaaaatcatgctgtactcaagaagaaaattagggtttttttgtggctttataattggatcttttttgcaagtatttttaattttatgagaggtatttggcctgttctgctagagaattatcagccaaatccttgctttctttatattatatatattttcctgagtgatattctagggaaatgtatatggatgctgttctctgtctttccattagcagcgcagtgttgggcttcgaatgatgatggtagatgattgggggtgggagaagaggtggggtttcttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtaatctactgcagtctttgttttctgggtcgtgtataaaatggagcaaaatggtagaaaaatagcttcagtgaaagggatgtacctgttaacaggaataaaatagaaaggaaaaggatatttttacattgttcattattatttctcacaacagcttttaggatttttatcatgttttaaaaaacctaatttgacctaaggaagaaaattcctagttttgaaaacccgtgccttaattgcttagctttagaacaaaggtttttacatccagcattgcaaggatatctttattcaaaagaataggatgcagcattcttatgttacctttttagaactgaattggcataacctctcttgaatcttagagactttgacgtattattctgtgaattgtgatttaattatctcatgcttcaggatggttgtttccctttgatacccaagagaccatggatgggatatagggggtggggattaatattacagtgggggaagggagtgtttttacagagtaaccttcctgtttttgcattggaaactaaattgaaatatataatcattggaaaaggtggtatccatggcaccaatcttatcaacttgaattattttatcctttgttcagtttgtggtatttttgctcttgtcagctgaaatgttgattataaatttgaagaagctgccgagttgctgtgatggcactggaattgcattctgctttctttttctttccaattatagctgtaaatacaggaaccaagggatgaatgtgaaaagaagtaatataaaatgctgaagatatttttggttttctcttgaaagtatttttcatagtgagaattattttcttgtggacagaaagagctaggaccctaatttatgacattaaaaagcatttaagtgctacagacttctctatttaggaaagacagactgaaaacatgttgaagcgtactatggagctttcagttaagttgattatttccatcatggtgatatgagttatcatactgtttgccacattttgaaagctgtttgactcctcagaagtattaacaaattaacaaattcttactgagcatttacattatgctaggttctttagatgtatatcaggtttatagtctagtaaaggatataaaaaactcatgcatatgatgtaccatttttggtgcaagcatataagtattgcagtgttatatatttatgtactgacatgtaggtgttttacataagctactacatttaatcctcataacaacctagtcacgaaattattgtcattcttgttatcctatgcacattagtccaaacaagcaaacaaaaattgtcattctcttttatagatgagaaaatttacattttgagagattaagtgatttaccataagtaacaaagccatgaagtgatgaagcctgggtcagtcagactctaaagctctttccactgtttgtatatgagtagattaaagcattttatcatgattatttgacatcacaaatagtgatgccatgagtgaaaaggagatagggatcctaatctttaatctatgccaagaactgagtgattgagcaaatcatttaacatcgtctgtaaagtgtgagggttggactaggcaaccttggttcatgattctattcagtgtaagagattttcacatatggtctatggaaacaattctcattactttagtgtttttattatatttagtttccattactcatccttcataatgtgctgtacatgttggattgtgtgtggtggggggggagggtgatagagtgcatatcatcttctaacatattacatacaatatacatttatttattaagattattactgtctgtcatcttccttcttcccttcccccaaatatgtcacgaggacctagactagagcctggctacatagtatgcagttataaactaattttttgaatgaatgaataggaataatagacttgtatagtacattggcaaaatatataagtaacttcataattcttaacaccaaaagattccctgggggccaaaattattaatctttctattacagtgatcctttaaggaactaagtgtaagaatcttaaaaagaagaacacctacgaaacaatcaagtgtagtcaagtaatctgaagtttgctggaattcccccatacaaaattattggtagtatagaacttgctaaccataggtttgtttacccagtgttctatttgaaagtagtttactaaagcattccatataagcaaagaaaaaaagcagcaaagtttcttttttgtttatgtgtcactgtatagtctcaaatgctgtaaatttacagtgagtagaaaatattcagaccattgagtcttttgcttaaaagatatttcgtaaggtataacataacgtttactggtagttttgtttcatttaaacattaggcttcttgagagttttaacagttttattgaaatgtaattggtgtataataaactgcctatggttagagtataatttgataggttttgatgtatatacacgattaggaaactatcaccacaattgagaaaataaacatattcaccccaaaggtttccttgtgcattttcataatttctccgtccctccacccctcctcacctatccccaggtgtacccattgacttgtctttggtccttatagagtagtttgaattttcttgctttctttcttgtcattatagattaatttgcatgtctttttgtaagtgaactcacatagtttgtgcttttcttatgtggtctcttttactctgcataattattttgagatttgtctgtattcctgtgtatcagtagttcatttctttttattgctgaatgatatcccattgtgtggatataccacagtttatccattcagctgttgatgggcatttgggttgtttcaagttttagactattaggaataagtttgctttggacattcatgtacaagtttttgtgtgtacataagctttcatctcttaggtaaacacccaggagtggaatggctggattatatggtaggtatatattttaactctttaagaaattgccagactgtttttccaggtgactgtattgtgttacattcccattagcaacattccagttgctgcacaacttcattaatagttggttttgtcagtctttttaattttagccattttactgtgtgtgtgatggtatcatattgtagtttttatttgcatttcatctgatgactaaaaatgtttaacatattttcatgtgcctgttttatcatccatacttcttttgtggattgtctgttcaaatcttgtttttaattgagcttttaattattgggttgtaagagttccttatatgtttgggatataagtgcttttattttttttttattttattttattttgcgacagagttttgctcttgtttcccaggctggagttcaatggtgcaatcttggctcactacagcctcctcctcctgagttcaagcgattctcctgcctcagcctcccaagtagctgggattacaggtggccaccaccatgcctggctaatttatttctagttttagttttagtagagatggagtttcatcatgttagccaggctggtttcgaactcctgacctcaagtaatctgcctgcctcagcctcccaaggtgctaggattacaggcatgagccaccatgcccggccataagtccttttaggtatatgatttagaaatactttctcccagcctgtggcttgtattttcattttttagcatcctctttctctctttaatacttttattgagatataattcacatttccttgagcaaaagttttaaagtttgaattctaatttatcattttttctttcgtagattgtgcttttgctatatctaagaaatatttgcctaacccaaggtcacacctctttgcttctagttttatagttttgggttttacttttaggtctgtgatacattttcaggtagtcttttatttttaatttttgtgggtacctagtaagtgtatgtatttatggattacatcagatattttgatataggcatgcaatgtgtaataatcacatcagggtggatggggtatctttcatctcaagcatttatcttttgtgttacaaacaatccagttgtactcttttagttatttttaatgtacagttaaactattttttactataatcaccctccactacccttcccagcctctgataatcatccttctactttctgtctccatgagttcagttgttttaatttttagcttccacaaatgagtgagaacatgtgaagtttgtctttctgttgctggcttatttcacttaccataatgacgtccatttccatccatcttgttgcaaatgacaggaactcattcttttttatggctaaatagtactccattgtgtatatgtaccacattttctttatccatttgtttgttgatagatacttaggttgcttccaaatcttggctattgtgaataatgctgcaaaaaacatgggagtgcagataacccttcgatatccaggagtgtcctaaatctaaggatgtgtcatattattttttctttatttttttctcctcctgctgttccgggtctctacagtgtcccctactcctttgttttattcgcacacctgggtagtgcctttccaatcaaaggatagttgggtctgcatttcaggtctgtgatctttatgtttagggaaatccgtttcctggtcaaagcctaccagacttccttggtatcactccagaatttaacagatttggcaagtatgttttttagttaatggtttgagatcataatcatttccttcatgctcctcctgccttctatttttgcttttaatattgaggaatgctaatggaatagatttgcttttgctctctcccatctttacctggaattgaacacatatttattgaaggaatgagtggtttgcaggaatgttgccattcaggtggagacatgtttctctttaaatatatagctggcaagttgcccatatggcacatagatattaactgaattatccactgagctctgggattaggagatacagattgtgtaggattgggagttctttctattggcttatcttttcctaaaactatgtaacgggatatgaatacctttctacctaagtatcttgtcattatactagatctagttttctgagtctcacttgtgaaagcttttggttaactattaataaaaaactgtacaaagggaagatgataatggtttctcttgtaaggtggtagtccaggggttgaaagcaagggttctagttagactgtgaggttttgaatctaagctccctcttctactagttatataacttgtatatgttacttaacttctcagaacctcacatttctcttcaataaaacaaggctaaacattttacttatagaattattgttaaaattaaatgaattaatgcataaaaagtacttaaagcagatactgtaagtatgcaagtaaagctactcaagttttagctattattgtaaccattttaattgttaattattgttcttatagataatggatgatgtgtttgaagctatcacctagcacaatttctgactaccaaatgtagtttgaggcttttgagtgtttttcacctaaccattcttcccaaatgaatatttttcagggaagctaaccccaggaaatgtgacacaatttactgtattgttccttacctctataatgtatgtttattctagctggttcatctcttccttatatacaagttccacagaatgatttttttctaataagaattaagaaacctttgttctgatgatgagcttatttaaatttgggtttaatttgatagaaaattaagctgtttccttaatggggaatctggccaatcaccatcctccaccctcccagggtagaattttttccaggaattaaatagctctatctagcagggtcttcctgcctttggcagtagagcagtacaaaggccacattgagcatagctgctggggaaaccctttttccttctctagcctataaatgctgttctgtctctgtgaaaagccctgacatcagctcttggaaaaatccaaatacttgtgttagaacaaggctgaaacacttgcctgggcagagactaatggctgaactatagttctaagtttaccagattgcctctcagtattgttatgctttaaaaaacaaaacaaaaactgtaagtttcagacataatctagagaaattaggatagaaaggacaacttaatagcgcctcccattctttgctagtttcttcttatttttctcttttttctaaaaatctaccttcaagataatgtgaaattcttgcttgaggagtgagggagagaaataatatatcaatattataaactttatgcagtgttttccacatattagatgctgcataagtatttgatgtttgagacaaaataaactgtaaacagactgtacttaacttccttagtgttcaaattagatcatgatgtaaaactctccagtggttttccattatattatgaataaactctaagcctgtttctgtggctcacattcttacattagctggcccctgtctacttctgtggatctcatttcagcactactttactactctcttggtcattttctatgcttaagccacagcggactttgtatttctcaaatacattaatctgcttatcctttgtgactcttgtactagctgtttcctttacctgtaattctgtggcccacatcttcccatggctggctccttcatttaagtctcagcttaaatgcctctaaggtcttttttgaataaactaaattaatgtatttagtcaaataatatctttttttaatagcacttaccacgatttgaaattctttggtacaattatttttttgtggagtttatcttcctcctgtggaatgtaagctgcttgagagcaaggaccttatctgttcattaacgtaacctccagtgtcttgaacctcctggcataggttggtgtttgtgtaactttgtatgtacttggctgcctgtaacggaaaacacaagtcaaactgacttaagcagtaacgcatttactggctcacataaaaaagaaatctagacgtaggcttcagagatttttgatttagggacgtaactatgtcaagggctcagatgctttccatctttacactcttgccatcaaaatcatcctcatcctaaactagtccttaaagatgaatgcgaagtagctgttaaggctgcttgcttcttcactcaggttcagtgggagggagagaaagaagtttcacatcattctctcaagaataaggaaatactttcatagatgccaccagtgaactttgtttctacttttattggcttttttggaaccaattgcttacccaagaatggaattactgttaggccaaaaaggcccatcactgttgctacagatggggttggcttgacctgagtcatctggactctgagaggaatagtagataactgaataaaatcggagttctcttaaaaggaaggctgtggtttctggggtaacttatatcctctgtagttctcaataaaaatgtatggaatgagtgaattcatgtagtaaaaatgtattgaattgtcaggcgtatgctcagcaccataatagttaagtagaatacaaaatcaaatagaatgtggtccttgccttcaaataatttaaaatctagtgagagagccaaattaacggaatattaaaattgttttaaaaatcagttgattaaaataatttaaaagatgaaaaagagaaaagggaaacaacagatgagacaaatagcaagatgatagacttaaatacattagtaatcacactaaaggtaaatggtccaaacaccccaattaaatgtatagactatcagattagatgaaacagcaaagcccaactgtatgctacaagaaacacaccttaaaattaaaaatacacattgtttaaaagtaaaaggatggaagaagatgtgccctgctaatctacattaaaggaaaactagaccacattaatatcagataaagtagatttaagattatagaatatcaacagggataaaaaaagtaatttcgtactgataaaagggtcaatttaaaaagaagacatatctaggcatgtatacacctaatgacaaaacatcaaaattcatgtaacaaaagctgacataactgaaaggacaaatagacaaatctacaaacattgtcagttatttcagtatccgtttttcagtaattgatcaaagtagataaagtaagcaaggatatagagtacttaaacaatactgttggccagtttgatttaattacatttttggaacattccagccaacaaccaaatactttttttttttttcatgtttgcaagcagacatgggacatttaccatgacagacacaattctgggctgtgaagtaaatttcaataaattaaaaggattcaagtcatacaaagtatgtttcctggtcaccatggactgaaattagaaatcaataaaagatctctggaaagtttccaaatattggaaaataacacaattcttagtcaaagtggaaataaaaaaggaaatggcaaagtattttgtattggatgaaaatgaaaacacaacatatcagaatttgttggttgccattaaagcattacataaaaacttatagcattaaacacctattagaaaagagagaaggtctaaaatcaatgacatcagcttcttttttttttttaagacagggtcttactctgttgcccaggctcaagggcagtggtttgatcactacagcctcaacctcctgggctcaggctgtccccaccttatcctcccaagtagctgggactacaggtgtgccccactaattttttttagtagagatggggtctcactgtgttgcccagactggtctcaaactcctgggttcaagcaatcctcctgcctcggcctcccaaagtactgggatttcaggtgtgagccaccgtacctgaccaatttcattttaagcaactagaaaaagaagagcaaattaaaaccaaagcaagcagaagaaaaaaaaaatagagatgaaagcaggaatcactgaagcagaaaacaggaaaacagtagcgaacattaaccccaaatctggttcttttgagaaaattaataaaattattaaacctctagccagctgatcaggatgaaaagagagaagacacacattactaatatcataaatgaaagaggtgacatcattacagattcttcagatattaaaaaaaaataggggaggctgggtgctgtggctcacgcctgtaatcccagcactttgggaagccgaggtgggcagatcacttgaggcaaggagttcaagaccagcctggccaacatggtgagaccccatctttactaaaaatacaaacatcagccggcattgtggcgcgaacctgtaatcccagctacctgggaggctgagggatgagaatcgcttgagcccaggaggtagaggttgcaatgagctgagatggtgccactacacaccatcctgcccaacagagcaagactctatctcaaaaaaaaaaaaaaaaaaaaaaaagataagggagcattatgaatagctttatggcaataaatttaacaatttagatggaatgtggttggtaattttataaattccaacaatatatatacaatatgtaaatatatattacatatacataaaacaggaaaatacataaaatatatatgcactctgtgtgtatgtatgtgtgtgtaatgaccgggtagggtttatcccaggagtgcaagattggttcaccttacaaaaatcaggcaatgtaagtaaatggatggtaaatggtggtaactatgtttctcactgtctcaaaggagctaagcaagagagaagactggaatgaacctgatggaattagattagaattagagatatcagtatgaactcatgctgagcttaatatagatacagatatatggatagctacagaaagaattatagatatgttgtattagtctcttctcacactgctaatgaagacatatccgagactgggtaatttataaaggaaagaggtttaattgactcacagttccacatggcttgggaggcctcacaatcatggcagaaggcaagtgaggagcaaagtcatgtcttacatggtagcaggcaaggagagctcgtgcaggggaactcccctttatataaccatcagatctggtgagacttattcaatatcccaagaacagcatgggaaaagacccccccccttcatgattcaattacctcccaccaggtccctcccacacatgggaattatgggagctacaattcaagatgagatttgggtggggacacagccaaaccatatcatgtgtatgtataccccagttagtataacacattcatttccctgctctctctgctgagagggcctagaaatggtgacatctcagtagcagtgagcgcacccagctcctggatcttggttactaaatatcactctccaataaaatagctccttggagaaatggttgactctaaggctgcaatagggaaaatgcaagttgaacctagagtgccttatagtgccacaaacaagaaagtgcccaaacagaagggtgagagcatgtcagtggcataaacgggaagaatttgagcaagagaataaataacgtagtattggattagaactcaaagtctaaaataaacatacatgagcccatactgataaaaatgattacataaatacatgggtgagaaaacacaaatcttccttacaggaaaatttcaaatagtatacgtagattcctattcccaggagatggagcttaatcctctcagatgctagtgtggattgggcttagtgacttcttcaaagaaaaaaatatggcaagggaaaaataataactttacagggagacgtcgagcaaccactcccttaaccaaatgaccaaagttaacattactagtgttaagtcatattggtgtcatatatcctctgatgggtgatgaaaagggtacttcacccctgtggtattccaaaaatagacccacgtatatatggaaaactgattttcaaaagtgcaaaaggcaattcagtttcaacaaacggtgctggaacaattggatttcaattggatatcacactctatataaaaattattacaaaatatattgtagacctaaaagtaaaatagaaagtcactcagctcttagaagaaaatgtaggggtaaatctttgtgatttggggttaggcaaagatttcttaggtatgataccataaacatgggcagtgacctaatttccaaataaagtcccacaggtatggaagttaagacttcagcatgtctttggagataacacaattcaacctgcaacaaatataatggttcccaattaggactgctttcatgtttaatacagagaaactgagaatctctatatgagtttagtgcttttcacatactacctaagaaatgcatcttccacatttacatttagtcttccaatgtgttggtgttgtcattaacaaaatacaaattctcctaaaaatattatgaattgtagctttgggcatttattcagtttgtggatagtataataattgctattatgtgtatccctgggttttgtttgtgtgtttgttttctactttcaacacaaatagggagagagtctctctcaccgatttcgtgccacactttgtcacttgggcattaaaataattttaccctggccctttgtcttacaaggtctgttgccaaaacaagcttcttcagcttctgctgctgtttccataaagatttgacatgagttcatggaattgatctcggggacgagtgtgtcctctcttttctgtttacctagtacccacagaaactcctgtcatttctagtccaaactcccacctggattccttactataaatgaattcatcccaaggaagaaatcaagggggagtatagaacttgggttacaaggatatttgttataacattctttattatgctgaaaaattagacccagcctaaatatttacaaaagggaacttcttaattaaatagccatatcacaggatactttgcagttatcaagaattatttagaactatgttttttaaatctttatctgatttggaagttcaatatatagaatgaataaaaaacaaagcagctctgatatgtgggaagtctagagccccatctacacactcccgctctgtgagggacctcttttaaacctctagaattttatagagcacagtttaaaaccagcactgtagtgaaatatttaatatgtaaacatatgttgatattttatgaagttaaagttgtcaatatgtccagtatgctttaatttttatgaaaataaattttaaacattgtatacagaaatctatctctattttgggaaagaatgggaatatatgcataacaatgctgggtgttgggattatgggtgatttttgtttactattttgtctttagtttttaaaagtttatacgtgtacttctttggacataaagaaagtgagacatttcttcatattgaaaaggcagagagaaccattgctttataggaaactacagtttggaaaaacggcagtctcattactcaatcccttgagagaggaattatcttgaaaatgttataaaaaatattagtaacagatttactagtgtcagtggtcttgtgtgttaagtatattaggataagccacatttgtaacagctaacggagaaaacataactgaatgtcagtgttacacagtgaactttgtagagcagtgattcccaattctgagatgttgtaagaggaatgtcagaattcctaaaacactcatcctccaacctttcaaattcagtgctgtggtgagccattgttactgataagggtatatcccacttgtgatttctttgttttgggtcaagaaaagcttttgtagaagccagtgtaaaatggcatgcatataattaatttcctcatcttttcctcataaaatcagaggtccttttatcgatggtggtttgaaagtctggggtattcagatttggcagcagaaagtgtgttttttttgtgtgtgtgtgataaactaggtggattgctaattctgattgaggaattcgtaatgtttgacaccagaaccagagcacttgtgaaaagaagtctctttagtacaaaaccaaaaatttaattacagcatttgttataactatagccaataaaagtatttttaatgaaaaagaatttccgcagaagaaaatgctttctattaatgcagaaggtgttatatagaagatttaattgtaatgatattggttatgatccgttttttgttttatctttacctgtattttatattcgtataacctctaaattttacaaattacccataatacatttcttatataattaaaaaaattctgagtacagaacaggaaatatgttcaatctttattccattagagttctacttggaaagtattaatatgtaaggtttttatttctccataagaaatagacctatatagtcaggcacagtgtctcatgcctgtaatcccagtgctttgggaggctgaggcttgaggattgcttgaggccaggagtttgagaccaacctgggcaacacagcaagacctggtctctacaaaaaaattcttaaaaaatttagctgggtgtggtggcatgctcctgtggtcctacctacttaggaggctaaggtaggaggattcccttgagcccaggagttcgaggttacagtgacctatgattgtgccactgcactccagcctgagtgagagagtgagacattgtctccaaaaaaaaaaaaaaaaaaaaaaaaaaaaaagaaaagaaagataaatagatctatgtctagttaattcgaggagatggtacacatttttagagcacatgagaacgaagtttatacttttctgattttctgggtttccttgatgattttttggcaaatccttgtctgtttagctgtctggcatatgtatgactgtggttgggcttctttgtactcaaccaatgaatgcataccaactgtaacacctgaaggtaggatcatgaataaatactctgtgatttggggttagtatagttttggttgttttcccttctcctgagatttcagaaataaaagattcctattcctgtgatttttttggcacacagtaagacatatttgatacataagataagtcattataattaacttgtcgaatcactttttcttgctgcagaatgatatttttatgaatgccttaggttttttcaataaaaaatgcaaccaaactgcaaatgtactgtgatttaaagtggtaatgtcagaatttaaattttgagtagtactctttttttaaatcatagaatgctctatgtttattcaaaaaagtaaaatattattagacagtattttttattttaattttgcatttaaataaagttctcaagctcagactgaaaagtaaacactgtatgttggagcctgtctcaacgacacttaaaagctaagactttctactttttcagaagtacatttgtatcttttggcaaatgtgtagaaagcagcctgtcctaacaaattttgttcacctgttctcacttcagtttatagattgttaaacatttaatcataatatattttatatacaatatttatgtgaaaaatgcccatccttgattaaggggatttttttctactcttatttttattatttttaccagtatattctgaagtagagaaatgtgaaatgagatgaagatttaaattcctagcaaacagaatcatgcattgcccctgttttataagtaatgagatcattttgtagagtccagtttatttacatttgttaaatgatattaatatctcttccataagcatgaatttggtggtttgcatggtgttcactgaggtgaggatacttgtttaagtattttgaggatctcatactttcctagcagttctttttacttggttttctgaagtgaatatagtctttaaaaaaaagtataaggtactagtaatcagatactcatgatcacaaatgaaagtggtggagaaaccttttaaggaatattcacaaaagtgataattttccagattgtcaatgaggaaatgaaagtctctaataagctgtcacattaattgtgagctgcatttctcagtcagcaacaactaatagtcaatctataatagctccagcagagggaatgaaagtaatttagaaaaaagtttactatttgatttgtcaaagtgtgtccaggaagtaagagagcctaaccaaggggctgttgtgcatgtaagctcttcagtaaaagtggtggtgtactaagctatatttaagaaggtaatttgagattttatattacatgctagtgaatcatttttggattttgcaccagaactgagctctttggtccctgcctgtctgtggtttgtgttgcaaggtccagaggcttaaaacaaagaacaccatgggaaattctccatgagtcattccgtcagctgtagcttctgttttatagtccttcggatataactagtgttttaatgccagctctcctagccgcttttcatgctttggttctatatgctaataaaaaagtatggcagtatggctattgtagataacgttcagacttttttttctcccgattccacaatttttagttcttctaatggctctaagctagaccaattataaattgtaactggtgaaaagatttatgactgtttattttgttgtagttgcgaggtaagcgagtggtcacttaatacttttggttctgtgaatcttactgtccagagaactaaagattgaattagcagttcagctggagtcagcactatgtgctaaatccctatacttaagagctcttatgtattgcagacaaatgtcctcttagctgttttgttattttgtgaaaaataataataatagagcaaggcagtttagattcatatcagtttcaaattttaagtaccatgttttaagccattctaattgttttgtagaaacagataaattaaaaacttgatttaaatccagcccacaggatgccttaatcacctttgatattttaaaggagatgaggaaataatggacttttttgctagtaagtggcaggtatggtcaacacaatttcactacatttgaaaaaaatcactttccctgcttgccaggaaaatttaaagtgcagattgtaacctgatcttttttcttacagtgtaacgtctgagaagttcaagtattgacatgaattttctatgataccacttggtaaattaaatctgtggtttcatcactggctttgaattatatatttctatgcattttacttagctaaaaacttatttgaatatttagtctttaaatttattttttcttttctgcttatttgaatacatatcaccaacattcagattttatttttgtttttcttaatagtaaatacataagtggttactgcttgctaggcaatgcttcttattttctaatttaatccccaaaacaaatttgtgaggtataggtagatgtattagtaattatgttttagaggagatgcttaaagaggttaagcaacttgttcaagttcaaatacctgttaaattatgaaactagaatattaacccagttacatttgtttctgaggagtcttttgcccccaaggccttgaaattttagggaattttcatttatagcaatcaataatactattcccatcccaccctgtccatttctgattttcaatagtatagtttctgcactgatatttacatcgtcttacgatggttgagccttaaaattacctgcattgttgtctgatttgcaattctttgtctagtaactcttctcactggagtgggttccaataaaatggtgctgtatttcactcaaaatcaagttgcagtgttttttcctcctcattttaacatcactaaaatcagagtgtatctactaatggaattcttgataattctaaatttaataggtaacattctttgactgctaataaaatcttaaccactatccaatgtaagaaaaatttgtttaaccatctccccttcatttcaaccattccttattaagaagaaccaactacagtctcaaatgctcctttataactaagcccagggaagacatatctaacaccctagaggagagagaaaagggtatgaattaaggtttgagtgtgatatcagcatttcttctcatatggcttcagaacacttctcactgaagtattgtcaaaaggctctttatgcactgaaatcaataaaagaaaaaaacaatttctagcaggctatttattataagcaaatatgtgacgacacaaaactttctggtcctttgcaattttttaagtccaaaagaaattctgtttaacaatattaaaggactattccagttacaaaattgtgtgtttgtgtatgcttattagaataattaaacttggttaaaatgtaagtcttactctagtatacattatttattgggtaagtgttatttaactaccaaatcacatttccctctacactgtaataacacatcgggaagggccacctagggctttaaaattagaactcagaatttaacaaggaaaaggtattctgagttgagtgaataaatgtattctgaacgtttaaggcctttggttaagatttctaaaatgtagctgtgcttaatatacaaaatcaaaagtaaaggcaggccaggcgcggcggctcacacctgtaatcccagcactttgggaggccaaggcaggctgatcacttgaggtcgggagttcaagatcagcctggccaacatggcgaaaccccgtctctactaaaaatacaaaaattagctgggcatggtggcacgcagctgtaaccccagctactcgggaggctgaggcaggagaagtgtttgaacccgggaggtggaggttacagtgagctgagatttcaccactgcactccagcctgggtgacaaagcgagacttaatcgaaaaaagaaaaggaaaaaaaaaaaaggcatctagccaccatatcccagtgattcaaattcctgataattctttgctttattaatcatcgttcttcattttggaatttgacttttttgctatctgttaatagaaaaatacacacacacacatataagtaaacacagtatattcattgttgaccaagtgtccaagttatcaatatgatattttcaaaaaccaggcacagtttcattaggcacctgtaacattatgtcatagtcacatacagctgttctacataatatcgatccaaaagatattgtcatgatttcatgattagactacacagtggacagggacttaaaaatataggagttttgttcaccagaatgtatttcatcagactaatggttgaactgatttgttgcttatgacctggccactttgtagctttcagacctgcctttctgtagcagttgatagtatggattatctgatcttccttcccttctgggacaggcttttctcttttctaattcattttcttaatctcctacctccattctcaatcatgcagatgctagtttctcccccatatttgagcctgagcattttttcaagtttccttggtgttttacatttcagtgaccatcagtaggttgataactcaaatctgcaactttagccccaggctttctttgaggttctagctttctatttccagctctctgattacatctgtctcaatattcagcatgtggtagggattttgcaaaactatgggattatcttggtgactttcctagctgaagcagagagaactaatgaaatagccaagaaggttcttgacattgttacttatgcatataagcatatatatacacacatatgtacacatatatttatttgctttagcagatactttaaagtagaattcaatgattagagaaaaaattatgattttaatattatttgagacgttcttaatctatacttgaagtagtaagtagattatgataagcaagttggactgtgggcgtggtccttgttcattttctcattccgtttttgtccccatttttcctctcctttttcattaccttgtaagagaaaatagctcaggaaacgggtttacaatcagtagtctgggaacttccgggattctttaccagcatccccctggatgttgcagtccctgacgcaagcagcattgttttagggtaggagtttttataatggctgtgaggtcgagtgcctaaggttgataaatggcagttgttatcctttgcagaaactcagttggaatcctttctgtcaacttgtatgttcatctgtaaattaagaaacatgttcccattccctccctctcctacctcaacagttatggacagactgcttaggaactcctatttctgaagatttcgtggtcttttgtaaagtcagtttgttctctagagcagtgtcatcttgtcccagaaccccctttacttactaccactacttctttgtaagttaacatgctatcactgattaggaaaggttttagattcttagtctttttctatggatcaattttggtttaaataggtgtcgaagggaattgtaagtcagcttgtattttggaggttttgtttctacctccatgccaaatgaaatgtagtcattgaagtatcattgtattatgtttatttctgtctttactaataggcttttttaaaaccctagttttactgatgttcttaataaagtacggttcctattactaaataatctttacataaaatgccataggttgaaataatttaaaagacagaaatcaaaatgtaggatgatatttgagaagacttagattagcatttatatatagcatcaaacgcttatcaagaagcttccggcagtattcatttaaaagagagagaaccaggaggaaatgctgtagttctttcagcttataggacccccccagaaaaacaaaacaggaaagtgccctttgttttctacttttggaaggtattttttgtaaccgataattactttaatgttaatttttttctagataatctgttattaaatctaaacctaataattgaggatcacgatgacatagatcaatagtgcagtaatcaacacccagatattttgggaagtagtgtgaagtgatgggaaggaaggaactttcccttctaggaaaacagtgagaataatattttaatggcaaaatatttctttttgtcttgatttttaaaaatctataaaatggaaagtatatctcttcatagagatttctttttttcaagattaaacgagataatacatgtggaaataatgcatagcatttggtaagccctttataaatttagcaattgctcttattattgggatttttaaaaagaaaagctatattctaggacagctgatggtaaatgcactggcagtttaagatttaacaaagtagttaagatacttaaacatggtgttcaacttcttattcctccagcttattgattcttgctattggaaagttaccataagatttaaatctcttattctggttcagtaggatgaataaatttagtaacaaaatcttacaagtaaagtaactacatctatccttattttttctttgtttcaggtttcccctcaaaaaacctataaggtaagtttgctcaattacacttcatactcaagtttaggttatattttaattataagcatccctttgaaattatggtggatttttgtggtttttgagaatgtgtattcaagtaattcaaaatttcaaaatgttttacaaatttaaaatgtaaaagatgttactttttctggaagacagcattgttttgataatacttctaatataagcatttaaaaattttgttcaaaaggatatttaaggtcacactgaagagacttaattttgaagtctatttgtgactgttttgaattatgagtagcttaggaggtgaaaatagaatgctagtttttgatgtgttttatcacttgtgtgactataattgcctttagttaatgtactttggtactagtttagtcttaattactttattttttattttattttattttattttttgagatgggatctcactctgttgcccagcctggagtgcagtggcgcgatctcagctcactgcaagcaccgcctcccgggttcacaccattctcctgcctcagcctcccgagtagctgggactacaggcgcccgccaccacgcctggctaattttttgtatttttagtagagacggagtttcactgtgttagccaggatggtctggatctcctgacctcgtgattcgcccgcctcaggctccgaaagtgctgggattacaggcgtaagccactgcacccagcctagtcttaattactttaagacagtgaagaaaaaaatccaaaatgttaaaatgtatctatgcctatatccatgtctatatatttattcatttccaggtcttaaatgcctcttcctcagtatttttgctttcagcatttcttctgttatcttatcataaatattatttaaaatgtaggtagtatgtcattcctaattattatattttatcatttttagtgtcagcatagtccaggatccaatgctaaccttggcatttcagtgaatatgtgtatgtgtacatatgtattattgttatggtcttgtcacccaaccattatctgatcagtgtaattggctaagccatagaagtaataataataataatgtcattggtccttaaagtggttggctaagacttctgtggctagaactacatcagcaggcttaaaatgaggcttgcctaaggctgctttttaaatgttaaaccgttctcatgcatgctctatttatgcagtgattttgaacttgatcatagtatatgtagagttggagaatgggtttaattccttttaggcactgtgttttttttgtctgttaaatggaaatgatagtattgacctgtgaaaaccacacaaaaaaaatgtaagcagttacttctgagaataaaagagactttaatgctgaatactatttttaattattttaagcagtttttataatcaagtaaatagactgtgtataaccaaaacttattgaaaaatgtaaattagagaggcttatggtgctgtgtaaagtaaactgatttcctggtttttcttgtaagatccacttttagaattttaaattttttattctaatgattttcttgcactaagcatttgattactttgctttaatttaggcatggaagtattttgaaccgagagtcaccaacagataagaagcagaaagttgagcgcattgcatcacatgattttgaccccacaggtaaaacactattcattctttcaaagagtattgagagtagtgaagttcagaataatagagcttaagctacccgaaacactcaggaatagttgtttgatctgttttaggactctcacattcctccaattatatcataataaagcctttgcatttagtaggaatgcaagcatttttaacttccaacactgtacattccactacagaagtatcattgtagagtatattgtatctttaaatagtgataataatagaaatggttatataataattggagatttggtcagatcaagaactcagtgttaagttgaatcatggtataagcagtaatatgtcataaaaccaaggctctaacaactcgacacttgcgtagtcatctaaaaattcaattgtgattatggtgaattggagttttagataaatcagtttcacaaattaatgatggtctcattttagagtaaacaaatgaatagaaatccctttctcttcagtcaaaaagtattctgaacttaaagagctgtctttcaacctaagcagtgtcgatctttcctagggttgtcaccttaacagactttcagattgatctccttttaaaacatctaggctttttccttttgctttctccttgtaagcttactccatatttgattcatagaaagtgcttggtaatcttgcttttttcatttgaaactgatatatattttttgtgcacatactattttattcagttgcctgtccctttgacaagagacgaagtaaatcccgctatctcagatacataaaaataatgtatctatttttaggtatttttacttagaaatataattttaaatatttaatagagaatagtatgttttatttatctaagacatttcatactttattagtataaactcctttattttgaaaaaatattataaatattatctaggaagcacatagataatcattttctgcattttgggtagtaggtaaaatgaaattccaatcatcaatttaggaggctttggtggtgggactatgtattatgtcacttacagatctccatgaagagagaattttccattctgatgcctaattttgtagtcatggggctcagaggctttcatttacatgattaggtattgtcttgccaataaggtcaaaagtttctgccctatgttcagaaaaatataatcttgttaggtttattttgtatctacatctgtgctgtgcccatctccaaagacagatttaagcaaagatgtatacaatgcttcataatgagatcattatagcttttagtgcttttgtcatctctacaattatcaggtgatatattttgtatactattcatgtgttgttttgtttgaacatatttttattgcactgtcttttcttcgataaatctttaaaatatgtcattacctgtgctgtttgtgactattctaagtgctgtcatctgttatgttcatactttgtgtttgcacgatttaacttgatcatgattcattcttttttccccatgaatttttccccttacattgtctccatattttctatatctctctccttttctcccgctcttgtgcagatagctcctccaagaagacaaagtctagttcagaggagagtagatccgagatatatggtaagctaatgtagctaattcagccttgccctttggagcttgcttcatggtgttccttttctgttctttttttcctttctttctttctttttaaataactgcagcctttcttgtgtctgctgtgcatggcatgatctactgcagggaaagggagcctggggttttaacgtggctgtgatgtggaagcttaaggttgctagaaactaacattgtagattaagagtaggccacattgcccatcttctcccgtcttgtttatggtaggaaggtgattatctctaatatgtttgggtcaggttcctccaaataacatgaatgggctttgaattcttgtcatcttcttcccacatctcatttgcagagtttggattatgaagaatttgaggaattaagtcttttcctctaagtataatactggtgtaatttagacgtattagcagttctttggaatttttatttcattttttgtttgtttatttttaattgcctcgtcatgtggaaaagtcattcttgtataatttatccacgatggcaaaaatacgtaagtattttatcttcatagcttgaagaatttgtgcctttgagaagtttctctgaagcttaatcggaatgggaaaatttcagaatggtaccttttaaataatcttaacaaagagcaagtttaacctgagtggtcaacttttgcagcagatgattgaaatgctaatatttctagactgtgtcctgtcttccaaagatacaataaccatgtttgtgaagttcatacctatttttccttttcctttgcagttttatttgccctctttccttcttttggagtctgattagggttttgttttggggtttttttttttttggttttttgttttttgagaaaagtgaataagagaggaattacctggagctaagattttaaaaataatttctgaaagactgataaattatttctttttttaggaagattccaaatttggcctcgaagggaaatcaggtcatctttaatagagccacaaatctatagagcagaagctcccccaggtgcagatagatgtttcctagcttgatatataggagaggaaaaaatacaggaattgccctcccctttttaagacatttgataattcacatctgctggcacttgagcccatatcagatactttttagtattatgaaagctcagtgtttggttctaaaccagttaattcttctatgttagatatatacacatagttctttacttgggtttttgtgaccagtgctttttctgtgtataccttttacagtagttcagcagtaaatgtatactgtgccttgtgacacatcaagtttacgctttttcttccttccagagtattttggctactgataagtaagaactacctaattcctggagactatatttctgttctatataaagagctttctatagtttatcctctccttaggaacatgaacattatctttatagctctattctttttcggtagcctttgcagtgttctatttcgtcttcctctccattttcctagatctgcgatgtgtatttagaagcttgttgtatgctttggatgaagactaacaatttaggaacctctgactagaaatactatactaatatttttcttagcagtgatagaaacattaatactagttcaggcatgccattggcttggtagtgatagaaacattttaagtggtaattgggaagtaaggtgtggcttctctgtgtgtttgttttttgagaacccttgaaataccttttttggaaggaactgagtccacaagtcctcaaaaagcactcatcggagggatgagttgattagaacagaattagcatgctaacgtaaatctctttgacattacaaatattttatcacctgtgtgaatagacgtctttagattacgtacagttagcatagatgaaaaagtctctctggggattcagaaaagcttgaaactactgagtagaatcatagcaactggtgacattctgctttagtgtagggtcttattataagcccacttcaaactttagagattatacattgctttctcggggtaaaattcattagctgagtacttaacaaaaatgctagttactcacatattatttattttaaactttcttggcttttttttttttttttttttttttttgagacaagatctcgctgtgtggcccaggatggagtataatggcgggatcatgactcactgcagcctcaacctcctgggctcaagtgatcctcctacctaagactccaaagtagctgggactacaggtgcacaccactgcacccagctgttttgtttgtttgtttgtttttttaatagagatgaggttgttgaaggaatgatttgccaggggaaaaaaaaaaaagaaagaaatagtagagacaaagtctcgccatgttgcccaggctgatctctgtctcctgagctcaagcagtcctcccaaaatgctgggattaaaggcataagccaccgcacctggcttcttagccatttttagagctactttgtgaactagatttactttgtgcatcttaaaaggaaaccaagtgtttgctttgtattgactttttttgttacatttctgcccagtgcggtcagttggttatttattccatttccccttatttgtccctttctacctgttagagtctattaaacgtgtatggatgcgttttctgatctacaattttaataatacttaattttattaatacttttgtgggttactgtaggaaatgagagattcagcaagggaattctgagttagaccatagctgctgcttaaccgctgtcatggtgtctgaacagattcctgctaacagtatttggttcaagaaaataagttatgtctttttaaagctgtcttagtgtgttcaggccactgtaacaaaataccatagactgcttggtttaagcaatagaaacttattttctcacagttctggaggttagaagatcaagatcaggatgtcagtgtgatcaggtcagaagattcccttgctggcttgcagatggctgccttcttgctgtttgtctcacatggcctttcctccgtgtttgccaatgccctttctttagtttctatgatattacatcaacctggttctttattctttgtaattattttgtctctctttatttgattgttttttccctcctgttttatacatgtaggcatgacccaagtttctgtccccaatctttcttccagtctccagtctaagtgtcccataaattcagagtgaccaaactggagttcatcattgttctctacagctggaaatcagtcttcctctttatttccctaattcttataatgacactgtcatttttccactcacctagtcttatatttccttaaagttatatttgacttctccattttccgtcgtcccctgtggtcagctatttgccaggtccccttgattctaccatcacaatatttttcatccttcactctttggtttcaaccccactgccttgtccatcattttattagactattataatagattcgtaacttacttttatttcagtttcacattgattcattaacttttctccattctatattctgccttgacttgtcagattaatattactaaagtaagaatttggtcattcacttgctaagaaagtacaggtagttattaagataatgccacaatttgtttccaatttattctactctgattctccttcagcgtttcattttccaaaacatgttttggcattcttcctttgcacatgccatttctgttgtcttgagtgaattaccacctataacttagaatcctactcatctttcaaggcttaattcaagtactgccttttcctaggattgcccagctacttttgttgtttctgaatgttgacatctgttttgtatttaattacttatatttatgtttatctttacatctcccataatgctgaacatattggagacactcattaagtgagttttgaatgaatgattgttgagattgacataggaagtattttagtagagaaaattgatggaataagatcttcactcatcctaattgaatctttctttccttctgaaaaacttgaagatagaagaaaatgtaacttggagacatttttctggtagtggtctgaaagaatgaaatcagcatacttggaatttaaggctcttcttgctggcaagactgtgcatttagaatcaagaagcttcttaatcaaaggattatctgaggtcttactcataaaacatgtatgtctggcaccagtttaaaatgagctgtttttatgaggttgcacatggcccttctccactcccttccctgaagctgattcttaagagctgaaacctagagaagtttggtcatgaaataaaataaaaggtgaagaaagactaatgtgctttcactaaagtcaatgtaatatggaagatttaacaggttatcttacatgtttaacactccattttcattaatatgccccacaccctattttcattataggagttatggccttctttcaggaacagttatagaatgacacttcatttttttttcactttcaaaatatgatcattggtaattatctattgagtaagaaggaagcagtctttttatgttggttttaagtgccacattgtaataacagaaaaaatatgtcttttgttatgataaggaaataaaagaaatggatagtatttatgtaaatttgatataacatctttacttcactgatgagatgaagcatgatatcaggtttatcagcttctaggcaaaatatgatttttaagagacaggaaataaagtttgttttgtaactagaggagttattttggggtagatggaaaaatcaaattattatagttggaattttgccagggcagaaggttaattagcgttcttatagaaatgttcctctactttgcatagtcttcaaggctgtgattttttttctaattagaaaatgtttgagtattttatttaaaatttcctttgtgtataaaattcaaatttatttaataactatttagtgagcacccattacatgccaggcactatactaaggcatagagatacaaagatataagtgactctacctactttctggttgttcacagtctggtacaaaagaattgcaatacattttgataagtgcagtgatagagatatgcactcatttaccattactctatatgcacttaaaaaaacagctgtgaagaaatactcatatggcaccaagaacaatgggacggaagaagtattactaggactaagtcttttgtttttttgaaaaacgtgtttattattactgttattttttgtagagaagaggtcttgctaagttgcccaggctgtgctcaaactcctggcctcaaccagtcctcttgccttggcctcccaaaacgttgggattacaggtgtgatccacggtgcctgcctgtcaggattacgtttgaaggaagtttaactttttataccagtctcactggttttactttttgaacactctgcctgtgtctatgcaaagtgctggcatatagcacatatcaaagtaattaggtggccttacagaactcatattcacagatagatacatttgtatggaagttatgattaataatctttataccagatgataaaggatttagcaacaaaacaaaaccatggactatatgagttgtagaaatcagaaaaagtaaaagtgatgaaagctggtttttgggtttttttttaattaatgaaatttgaagattgctattttggagttatgagtctacttttatctttggctttctctgtaacatacagggcctattttctgtaccattttctgattcttaaacattgtcatttttttctccatttgttttcagtattgtcctgccaggattttatgttctttgagaacagaaactccaagtagtcttgggttcttcacagcacctatgaactgcagtgttaaataactagtatggacagatgctcaatgcaaatttgctaaaacaaacaaaagaagtaggatttttgtgtgtgtatgtcaaaaaggatagtacaaagatatgataatgtagccagtattggtgattttagttctacagagggtggaatttttccctctgtggtaggttaaaacagcttctggtcaacaaatagaatatttctctgaagaaaaagggaaaacatttcatttgattttgaatgagagggaacataatagatttgagcatttgaaggactggatttctgaattttgaatggtaggatggcttcgttttcagttaattattaccacagatctaaatttatgcagacaccacagatagacaggacagaatagtattgttaatttgaattttatagattctgaattgactgtatgtgtaacactttttatattggtctactgatttaaagtacatgttaaagtacatcaatctcacattagcaggtaaatataaaataataaatgtggctaatacagtggatttggggagaagaaaaaattgaataggatgtgtgcatagttctttttccttttcctctttattctttgtccctcatctccttttgctgtagaattaagagggaaggttatcagactgagactgttatgaattggagataagagatttgctgtattctgaagtaatactaataggttttcttgattcttattaatctgttaggattctaggcatatttataaaattgactgtgcatggtgctgtttttttctctccgatgacctccctttctgagcttcctttcatctctagacttgtctacttgtctgaatttcattaattcataagcaatttttttaagtttccttctgtcccagaatacatgcaaggttctgagataagattgtgatgaagatacagcccctgcacctttggagcataaaatccaatgaaagaataaaaacaaatacaaatcagtgtgagtaagggtgatacagtaggagtacacagagggtgcagtgggagtctgtaagaggggcacctaacttcagtatgcatatttaggaaaagcttgtaagaagactgattcttttcttaaggacgtccagctgtctctcatcttctaaagctgcctataacaagaagctctgcccttttaaatttcccttctgtcttccttacccatccaaaactactttccttgtttgctaaaaaacaaaacttagacataaatcataattgatcctcttttttttttgagatggagtctttgttgccaggctggagtgcagtggcgcgatctcggctcactgcatcctctgcctcctgggttcaagcgattctcctgcctcagcctcctgagtagcctgggactacaggcacgcgccaccacgcacagctagtttttgtatttttagtagggacagggtttcaccatgttggccaggatggtctcaatctcttgacttcgtgatccgcccatctcagccttccaaatgcgcccagccagaattgattctcttaaggatcatttgcattaattgataggagtttattaacataaaagtacttacaattgtactagtagcatggatagaggagaaaatccaaggtcaacctccccttaatcataataaaataatatttaacgtgtaggaacccttaatatttgttagacattaagctaactactttatatatttttttattcaagtgagaggtgcaaacatagcaaactccttgactccaaatacccgtttccctcatgttttacaggtgtcctgttctctgcaggcatctgaaaaaaggtctatttaagaagcccaggttgcttagcactgcagtcacccatattagaaacctttaattcattaattttcagcttttgtgaggtgaggtgggagaatggagaagcacgaatatagtatgaaaaaacgtattcagtgttataattgccttgatttctaaagtcacagtatctaatttattttgaaatttcaaataactataagggaggttgtgaaatatttgtttccaaaagcaagcatggattttaaaaggttcctgtaaaatgctgcttagtctaataattttttttttttttttttttgagatggagtctctcactctgtcacccaggctaggctggagtgcagtggtgcagtctcggctcactgcaacctccagctcccagattcaagcagttctcctgcctcagcctcccaagtagctgagattacaggtacctaccaccatgccaggctgattttgttttatcatgttggtcaggctggtctcactcctgacttcattcaggtgatccacctgtctcagcctaccaaagtgctgagattacaggcatgagccaccatgcctggccagaatctctgattctatttattatatgctagaatttataaagaatgctttttttaaacttgatttatatattcatatcctattttataggtgtcctaattacttgaaggaagtaacactgaacagataacaaaggttgaattctaatgtgttatcacctgacctcattacaatttattgttttgtgagagtggtgaatatgttatttagtatttagaagtctctagaatttaggggtaacacatttttaaatgttgaaaatcaactttattgaggtaaaatttacataaaataagatgcactaattgtaagtgtatggttagaaaattttgacaaatgactatgcatactcatgtaaacattatcttaagaaacagaacatttccatcactgcagaaagttccttcatttcattttgcagtcattcccactcctcttccgtgcttctcccctaggcagttgctattctgctttttgttgttttagtttagtttttccttttctatgttggagtcatgtagtgtttactttcttacatactggtttcttttgcttaccatgatgtttttatgtttcatccatgtttgttgtatgagtagtccttttcttccttcctaatacattgtatggacatacgacagtttgtttatccattcatccgttgatagacatttgagtttctagttttgggctcttatgaataaaactgctgtgaacatttgtgtatgtctttctgtggacacaaattgttctttctcttcagagtaaaattaatggatcatatgcaaatatatgcttacctttataagaaatttccaaacagttttccagaatgttagcacattcccaccagcaatgttataatgttctaagagttctagttgctccacctctttgctaccactgtttatgattagccagactagttggtgtatagtggtatctcattgtggttttaatttgtattttcctgacgactgcagctgttaagcacctttacatgtgcttattggccattggtctatctttgtaatgtgtttatttaagtattttgccccctttaacatttgtcttccattattggctggagagttgcatataatctggatacaaattctttatcagatatccatattgtgaatattttctctgtggtttgccttttcattttctttttctttttctttctttttttttgtgacagagtctcgctctgtcgcccaggctggacccgcctcccaggttggacccgcctcccaggttcacgccattcttctgcctcagcctcccgagtagctgggactacaggcacccgccaccacgttcggctaatttttttgtatttttagtagagacagggtttcactgtgttagccaggatggtctcgatctcctgacctcatgatccgcccttctcggcctcccaaagtgctgcgattacaggcccggcctgccttttcattttcttaccagtgtctttagaatagcaaatgttttaaatttttgtccagtttcctaggttttttttcttttatggtttataaacccaccctaaggtctttttttaatgttataaaatattttgttacatgtattttatctgttttctttttctttctttcttccttttttgtttttttaataccctaaggtcttgacgatttccttttgtgttatcttatgaaaaattttagcttatgtttaggcccatgatctgctttaatttttgtgtaggtcatgagttcaagggttaaggttcatgttaagctacagtaggctcatgtactcatgatgtgtcattatcagcaaaaatagatatgtatatacactgtgtgtatatatatataatttgttatatgtatatgttttctatgagccattgtacacacagtctatatatattttttattaacatatctttagcatatcgtttggttggtaaatcagacttatatttaaaagattgtggctttttgtataaaaatctttagaaaaagtttttattttctattcattatctttgtgttgttttacctgttttatatattgacttcggtgaaatgcttagatcctgcaaagctgaaaatatatgttgtctctggctaacacagagttcaagatcttcagatctggtctatgataaaacagccctgggtactaatcagggttctaccctggcaggacatttctattcctctggctggggccctctttctctcaccttgccctgacagttttcatttgctgtttagaagaaacacaaattctcccttaggaatcaggtaagtatatgaaagagatgaaggaactggttgagctcacagattctttatcttttctatttttttctcttttctgtttctgttttctataagccagggtttttcttccccctgaactcttcctttctcttcccttctttggggaataacttcaggtactctgtaagcacctcctttctttttactgttttcctgagtatattttcttgagagtgagactggatttctgcagaattttccttgagatgctcctagccccatgtcctaagatggttgatttttcttgggttaaacaccaattagggtaccaaaaactcagggcagtggggcagggggagaatttttttactacagagaaatagcatggatgtgaatgggctttccttctagctgtctcatgtctaatacttaatattttgcagtttgccatagctgtttttaatattggagcaattctattatactccgccagtgagaaaacagtatgtgtgactctgtggtgttcttgtgtttgctttgttgatggtggttagtgttcttattttaccatgtggatttacatgtgctactttttgtttctccagatggaacacagtttattactaatatataattattgtcttttcctttctctgttttctcttccttcttgttttacactgtggttcttgtgcaggtcttgttcagcgttgcgtaatcatccagaaagatgacaatggatttgggctgacggtcagtggagacaatccagtcttcgtacagtctgtcaaagaaggcaaggcattttaaaaaacaatttatcactcagtaaacagagtaagaatagaaaagcttaaataatggcaattgccaagaatagaataattacatagattgcaggtcatgtggactattgtgctagattcgtctatcatgtcatagttacaggaaggagtttactccagttgatttttttttgtacttgttagaaagaaatcagtttttatttagttttagaaatcatgtgactccttggtcatgatactttattgtccacacaaaagtttctgaaatttcagttttccatggcaccactgatattttggcaaagacagattaaagagatagctatggcttcagaaataccatttattttcccaaaacaacagtgataatattttctactgctgttaccatatattgaatacttcctttatgttgggtgctataattttgaggtagacaatttttttatccccattttataggtgatattgaggcttagagtaaagaaacatcaaatcagtccaaggtcacacaactagtgagtggcagaagcagcatttgaatgtaaagtctgactttacagccttgttttttttttttgtttttttttttttggagatggagtctccctctgtcaccagactggagtgcagtggcacaatctaggctcactgcaacctctgcctcctgggttaaagcgactctcctgcctcagcctgccgagcagctgggactacaggcacgtgccaccacacccagtgaatttttgtatttttagtagagacggggttttaccatgttggccaggatggtctcgatctcttgacctcgtgatccgcccgcctcggcctcccaaaggacagcccatgtttttaaccagtttgttatactgtctctctgtcaggaagatgatcagtaaatgcaaatgaatcacattttaagcaattaatttctcatacagatggagcagccatgcgggctggagtacagacaggtgatcgaatcatcaaggtaaggaataggctattatagaatttacggtaggattaaaaaacaacatatattggtcatattctgatttttttcacttggatttttataaaaagcatcatacttctatgtatgatagatctgttgactatacaaacttatttcatttgttttaaaattaatactaccctttactgaaggacgtaataaaaggattgaaaataatggaggaatatatgttcttgagtaggagagtaattcagggttggaaagatcatttctgtctagattagtctgttattaagcaattctcatcaaagtacaagttgaacatttctaatctgacacctgaaatgctcccaactctgcaagtttttgagtaccaacatgacaccatgaatggaaaatttcacacctgacctcatgtgatgggtcacagtcaaaagttggtttcaccaggtacagtagcttgagcctgtattaccagctactcaggaggctgaggtgggaggattgcttgagtgcaggagctgagactgcagtgcactttgatcatacctgagaatagccacagcacttcaacctgggcaatatagtgagaccctgtctttacaaaacaaataaaaccaaaccaaaacaaaaaacttggttccatgcacaaaagtatttaaaatgtataaaactaccttcaggctatgtgtataaggtatatatgaaacataaaaggctcatatttaaacctgggtctgatccccaagatgtatcattatgtatatacaaatattccaaacttcaaaaaaatccaaaacacttcttctggtaccaggtatttcagataagcgatacctgacctgtatgcaaatagaattgtagtggtagatgtctatctgattattcttccagatgaactttataaagatataagaatcactaaagataaaaacatgttatatgtatgtgtatgtatgagaagagatgtatatgactctaatctagatatagacctaccagtggaacacaacagagagactagaaatagattttgaattcagatcagtagagaaagaatgggttagttagtaactattctttaaataattgactaatttgattacttaaaatcaaattattacataagaaaacataccatgaaaaataatttggaagaaatatctgaaacgtatcacagaccagatatccttaaatttaaagaacacttttaaattataagaaaggaataaatattctaaaagaaaaatgggcaaagaattttatcaggcagttccctaaagtaactgaaatacataacatattaatgaggatatggccaacctcactgataacaaagaagaagaaattaaaatgataggtgaaaaatacatttggctgtcagaaaatttaaagattggtaatacacatttagtatagtttgggtatggtaaaatgactattctcatgagttcgttgtgagtataaattaggtaaaacctgtttggatgaaagtctgtgaatatgtatcaaaagcctttaagaaagtatataacatgtgacaagcaattttgcttttaggaacttatctgaggaaataagtgtacaaatgtgaagtcgtgtgtacagggaaatttgtactggctttattacataactgtgcataaactgagggacagagaaataaattatattccatttgcagcttttgaaaagaatggattaggtcagtgtgtatctttattgaaagatagctgccgtacagtgaaaaaaaagttttattttttttttccaggaaaaagccagtcgtaatgtataatgtttatgtgtctctttggtgtgtgtatactagaaaagtgtctccaaaattaaatgtcatagctaacagtaactgcctcatggggcaggatgagtatacttgtacttctgttttttacactgatatatttgtattttagataacttggatcagagaattaatcagaaaattaatgttaaatccacatttgatagttttgccttgatttgtttggtttaattcagaatcgggataacattttctacatttagccggtctgaaaattaattttctttgtgaagattagatcatggttgaaaaactaaaagcaaattgaatattgtggaaatacttattttaaaaattattttttattattaattttgacaaattgatgacttggtaattaaaagcaaagagatcttttctatttgtatgagcccttcaccgtgaacgatttgtaaatctgtttcatgttatgttttgtcatttgtcatggtgaataagttgtactgttttgtatgtcaaggcctcggtttatgtttaagttcattttgttgctgaatatgccctgtagaatcatggtgtgaaaatgaatattgaatcaaatacataaatattttaatgtaatgtgattactatattatattggttatattatgtatgataattcttgaagtcattttatccattgtctcaatagaatgtatctgacatacactactttcgttttcttacaggtgaatggaactctggtgactcattcaaatcatctggaggtggtgaagctaatcaaatgtaggtgaatgttattcttagttttaattgttttctgaaacccttaaagtaaggagcagcaaatttcctgtaataggccaaatagtaaatatttaggctatgtggactatatagtctactgccgactctgtcattgtatcatgaaagcagccatagactatatgtaaatgaatgggtgtggctgagcttcagtaaaactttatttgccaaaagtctgtgatcctggtttagccccttggctggagtttgctgatccctgcattgaaggaaaatctgaggtgaaaactcttagcttactaatagctatcttttgtcaactccatttatatggttgattataatattcctgtcattcttggtaatatttgatacatatatttgaaagaaatgcatgagtcacctgagaggaaggaggttgagaagtcagacatatggcctgatgaactgaaatggaactttaaaaatcatctagcacaatcactttccctcagataagtaaatgattatataatccagagtagcgatcttctcttggaaatctttagggttaagaatttgtgatcttcaggtttgagtgaatagcccacttggacttagttctctgtggagaaacaggcttgaagcagtgggagtctgcagctaacctcccgtcacttgcagggtcaaaggtggattcacgaacctcgagctggcagtgagttatgggcaagccaggcctcagccactcacagggcctcagttttcccatctgcacagggagaagggaaggttcagtggccctgtgagctttgctagcaggtggtgatggggtgggtcatctgaatctgagtcaggtggaatcttccccaacctgggctttggtttcattttgttgttatcctttaaccttacctgctttccaagagagattttatgttttcttggttttttttttttttttgtttgtttgtttttagggtagggtcttgtagaatgcaatggtgcaattatagctcactacagcctccaacttctgggttcaagtgatcctcccaccttgttttttgttttttgttttgtcttgtttttttggtagagacagggttttgctgtgttccccaggctgctgtcaaactcctgggctcacccatctcagcctcctaaagcgctgggattacaggcacgagccactatacctggccaagattttatattttctaattgcttcacatactgaatggaaaatagcatgacagttataacagaagtaaagaaagtcacatgagagtccaccacctaaaatataacttcctttttctttgttctggcctggtttgggccgtatgtatttgttattgtatctcttaaaaaaaaaaaaaaaaagagagagactgcttgaactgaatgaaatttttttaaaaaaggaattaaaaaaagaatttatgatcttctgcatcagattattccacagtaaagtagactagaaataagagatagttgtttgtgatcaatcagaatcactactgttttatttaattctgtttctctgtattgggtggatggacatcttcaaaagaaatttaataaactaacttttttcttggcctttttactgctatgttaagcaactatgaaattttttaaactttttcatcagagtaccagtgctccaaatggtcactttgatcagcgttctttagtttaaaagagtgcagtgatcaaaattagatccccatacttgaataaacttgaccacttatttaatgagaatgtgatttataaattgttatgtgctgcataaatatggtttatgttaatgagtttatgcctgatgtccattgaggtgtataaaaacatttctttagctttctaggttatattttttgctcattccagtataaattttacttaaaaaattaaatcctgggattctagcaataaattacttacccaatagtaagggcatagctaaaaacttaaagtaaagcataaaaacctctgcatatccaaaactgatgtaaatttgacatcacatctgtaaagcctgggtgtatgtaacagagttcctgcatgtcctactttctaatgtgtattctggatataataaaagtgatatcaaatcagagcagtttagaaacagctaaagaaaggaagggaaaagctaggaagctattaaaaccaaatacataggcaagtgagatataatagatgactttctgatagagagcaataagattgaagagccttagaaagtgtttatatgtaaaattcctccaaattataacacttgtgagtattatacatagcaaaactagtttttagaacaccaaaacactgtgaaataattgataatgatttccatgggagggttaaattgggagacaagtgtgaaatacatttaaaagttctattgaaatatctaagaaaaaagttttgccatatctattactgactctgattatggtgtttttttttgtttttgtttttgtttttgttttttgagacgaattcttgttctgtcacccaggctggcgtgcagtggcgcaatctcggctcactgcaacctccgcctcccaggttcaagtgattctcctgcctcagcttccctagtagctgagactacaggcatgtgccaccacgcccggctaattttttgtatttttagtagagactgggtttcaccatgttagcaaggctggtcttgatctcctgaacttgtgatctgcctgcctcagcctcccaaagtgctgagattacaggcatgagccaccatgcctggcctgattatggtgatttttgctgtctagattcccgccccccgcaatatgtctactgaattcctgtccattcctccaaatattttctactaaaatttactacttattattgattgtgtttttccctgttattgtggaatattttttggtcatactcattttgtaaagttaatttaaaattgcattttatgttctagcatattcactaaaccctgcctagttagtgtcatcttaaaatatgaagatctaggccaggtgctgtgtctcacacctctaatcctagcaccttgggaggccaaggcgggtggatcgcttgagctcaggagtttaagaccagcctgggcaacatggcgaaaccctatctttaaaaaaaaaaaacattgcagctacttgtgggggctgaggagggaggattgcttgaacccaggaagtcgaggctgcagtgagctgagatcgtgccgcggcactccagcctgggtgacaaagtgagaccctaattaaaaaaaaaaaagaagatttaaaaaatttacatttaagaaattaattaaacatagccactaatagatggttgattttaacactcctctaaataaagaaaatatataatatattcttggagttataaattttatttgcttttaagtaatatctgatcttactagtagtaacttgctatctgaaaacggcatcattcttttggatttttagggcagtcataaaagagaaatgacaaattagtttttttttctgtggagacatgatgtagcagatgatgggactgtcttacataactggatcttttagaactatcgaagattaagtagtaaaatggtataaaaagtttcttgacaatgttattttcccttcccttccctttttccgtctccccaccccaagctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggtaagaatggggaaatttcttagttaaatgctcagtcttataaggatgtgtttactttatatggagagttttcaagtattcggctgatgaactaattaaatttaagattttagaaaatgatttactaatataaaaattacataataggaatgattagaatattgtcatagcagatttaatttaacaagtattagacacctgccatatgtaaaacagtgtgccacccacagaaatatagttaaggtactctatgttcaagattatagtcatcttagaatgtgtacttttaggagggcggggatttttgtttattttgtttactgttacgtttccagtacctgaaatattgcttagcatgtagaaggtgcttaacaaagctttgttgattgagattaagtcaagagtatacaagtaactataatacaaggcagaatgtagacattatgagggcaaaaaaaatgctaagttctatgaggattcaaaggagggagaaagcacatagaagaagaacaataaatagaaggagccaaaaaagcatcaaatattgtggagaagtagctaggatttttggttggttggtgcctgttaaggatgtgcatagtgggagatgaacttgaaaatagtaggttgactatatattttgaaaagtcacatctcccaagctaatttacatgtaactagataagcagtaagaatccattcaatgttgtttctttttaagcaaaagagtacatgattatcctaggattataggaagactaatttggtaaaatattatagggttgtgaaacaaggagggatgatgggtgatgaattagggagctgtcttcatatttcaggtaagaggtactgggagtttgagctatgcatggggatcgatagtaaagatccaaatgagggaaagtaaaagatactattcttatactaagacaacttcatttctccaatatcaatatttagtgttctcttgaatccagtttagtaaaaatgaaatagaagggcagacatttccttgtagtttcttgtaagtgtcatgtctgaaagcctgtccacataacccggaagtaaaaacctaataggtattgataattggagccgaggcagaactttgtatgccacattttctctatttattttagcttcattttgtctatactggttgttgtttgttttttatctttttcttttctaggaggaaaacaatgtggttcataaccagaaagtagaaattctgagaaaaatgttacagaaagaacaggaacggctacaggtattaaatgagaagtagggctgtttacaggccaataaaaatgtgagtgggcatggttgagttggtgtttatcagtcacaatcaagcagcattgtaaccaatgccattagttatattattgattaagaatggactatttctgtatcttttttacataagtaattaattctgaaaatatttttataacttttcagttattgcaggaagattacaaccgaacacctgcccaaagattgctaaaagagatccaagaggccaagaaacacattcctcagctgcaagagcagttatccaaagccacaggctctgctcaggtagcatcactattacaagtgctacccaactttttgcaggagaattttcttctgggaatgtgtcagagaatgttgcagttgccttttttaaagttatttttctagcgtaggacaacaggatgtcctgttaaggatgttacagaagtaatgattaacaaaaataaatgtgggcgtctgattgtttgcttgctcatgagatcacatttctttgttccataataatttaaaaaagaattgagtgcttttgctttgatgtgacaaactactaaaatgtatttagatatatatatatatttatattttttgtggttcattctgccatcttaaaacagaatggcagttgatatgtttttaaataggaatttaagaatttacaacaacaggcattgagctaaatatatggacaagcattttcttatttaatctgcataacatctctgaggttacttatggttgttttcctccagtttacatatatacttagagagagttagagagattaaatgacttgtctgaggtcatatagctgcaaagtaatagaactggaattcaaacccagtctgaggatttaaaagcacattcatactcttaatgactatatttttattgtaatttaaaaatagatttcagtagaatttgctgtatagttataagctatagagataatggtctcataagaaaaaaaaagctcagcatttatatgttaaccagacttacattctgtaatattcagatttgggatatgtaaagcaccttgtacttcatcttaaagcaaagtagataaattgcctatacatttaaaataggtaaaagctgtttttttgtcactgttcccgagttaaatctgaagggaaggctgcatattcgcaaaagaattctttgagatcatctagcctaatctgcttactttctgatttaaaaaaattatgttataattgagaaacctagggtctaaactggttaaatcacctatacaaggccatacagtatgtaaggtcccctgacatcctggtttagtgtacttttcattccattgtttttttcattaccttcagtcccagtagcgatgtcacattttgagtgttacacctcagtaatgttgacagttttatgttattactaggcaaatataatattcttaccctgtttggacagcaatctaaatgcttataacctggccaggcgcagtggctcacacctgtaatcccagcactttgggaggccgaggcgggcagatcatctgaggtcgggagtttgagaccatcctggccaacatggtgaaactccgactctactaaaaataaaaaaattagacaagcttggtggtgcatgcctgtaatcccagctactcgggaggctgaggcaggagaatggcttgaaccatggaggcggaggttacagtgagccgagatcctgccactacactccagcctgggtgacagagcaagactccatctcaaattaaataaataaataaatgcttataacctgatctaaatgcttataataatttatgttatagtattatgtcctagaattggccattgattgacactctgaagcattggaaggtagttaacaagaaactatagggtaataacctttattaatgggcagacaatataaattatataaatataaattacataaattaacaaaccattttatctttttgctatatttagaagtttgaacttacattctttttaccaaaatatcacttgccctgtctttaaggtcatgacattttagaataccggaattagtagttatttatggattttactcgtagaattttaaacatacttgagcatatcagaatgtccaacttttagtagtctccatgtagattgtagtaccactatttctttatgcagcaagtaatgaaagttttcttttatgtgtttgtgtgcgcgtgtttttctttcatctgttttaggatggagctgtagttacaccctccagacctttaggggacaccctaacagtcagtgaggcagaaacagatcctggagatgtactgggcaggactgactgtagcagtggagatgcttctcggcccagtagtgacaatgcagatgtaagctttcagttttctaaatcttttttcttctgtattcttctttacagcccctttctagatttgattttaagtgatgtgaattagaggtgtcttagcactttttaccatccccatttttaatgtaccaatttgataaacagaaatctggttactgttatatataagcttttaattccagagttcactttttcccttgaacacccattgccaactgtttcttttacagggatggaatttcccagcaggcatcttgttcgtgggtagagaagttactaatgccagtgcatttttactgaaccgagagaccaactgttgatatctttaagagcatgttaatattccatttgtggtcagagtgactcagtcttgaatcatggggcactttgccattaccaagaggaaaaacctcagtcctgttagataggcttcagttaatagcccaggtttagtgacagcactttcttgattaacccagaaactgccagatgaacatgactatctgttaagatgataataaaacattttaagctgaatatgatgtaacaccatagacatatgaatacctaaaagctaagttcagtattacttacccagcaatactttgtaaattgtatgcagtggtaggaataatgacttaaatgtagatcaccctctttaaaagtgatgagggaagaagtctgaacgaatgttttgtaattgtgggtcatgaaatcaattttgtgggttgtatttcttttttaaaaaaagaataggaaatacagtgctttgcatatagaagaggtgtcacttcttgggacttttgttacatatacacacatctactatttaacaatgtgaagtttctctcttattgaaggttgttgttgggggattgttttgttttgttgttttttaaaaaggaagccgtggtctaagccatcattcaggctatctcttgaggcttaggcccaatgacccagttcctcatgcaaaaaacaaactgaggatttgtgggttttttgttttgttttgttttgttttttaaggtagtgataggagtcttgtgattgggttagctaaaggttttaatggaaaatttcaatttgggctcaaggaaaaaatggtagtcactaatatttgttgggtatatgtcccatacacggtgataaggttttatgttccttagttaattctcaaaacagccttatgaagtagtactgttgttactgtaactttacaaaagaaaaaattgaggccaaagggagttaactaactttccaaacttattcaggcaataggtgatctacttccacctagctccaaaataccagtaatcgaaatataaacaaaagcactgaggtttgaaaatgcgtaacattttgagagagcagtgagaattttagggcaacctggcatattagggttatagatggaatggctagagattatcttagaagccaaatcatgaatccaggttataaagggcttcaacttgttctagcagtacataccgcttttgggaatgcttttcgtactcttctttttgttttagtaatgcgtctcctcgctgttttcatggcttgtccctaccatgagatgggaagttccttgagagcagagggactgtcttgtctgactttatgtttccaaagtgtagcaaattgtaggcattcagagcaaatgatacgaatgagaaatttgaattttatcttgtatttagaggaatgttacaataaaacatgtgacttagaaatataaccttataaaagagtgaattgttggctgggcgccgtggatcacgcctgtaatcccagcactttgggaggccaaggcaggccagtcacaaggtcaggagttcaaaaccagcctggccaacatagtgaaaccccgtctctactaaaaatacaaaaaaaaattaactgggtgtggtggcacacgcctgtaatctcagctactgcagagtctgaggcaggagaactgcttgaaccagggaggcggaggttgcagtgagccaagatcgcgccattgcactccagcatgggtgacagagcaagactccatctcaggggtgggtaaaaaaaaaagagtgaattgtttagtatagaaataggcattccaatcaattaagactgtttgacatgtaattgatacttagtatttgaatacatgaaatcaatgaataaagtgggctttatcttgcatgcagaagagagacaccatcagaaacatatctgtggaaaatgatttggtgtaaagagggagatctgtaagaaaagaagactgcttggcttaataggaactttaacaaatgtgtgctgaatggataatagttagcatttattcagtacctactttgtgccagaggttgtacccaatgctttacagatactcttttttaacactcataataatcttaaaaaagcagtatcaccatttcatagatgaggaaactgaggccaaataaataaatgaatattgtggaaatccgagtgagaaatgataaagtccaagctaggctatcttctgaacacagaacacacaggtttaatttctacaagtgtctgaggctaaagatgtgttgcttttagcttatggatttccatgtttgtttcaattttaagtatggaggacccggtctgcttttgttgttgttttaacagtactttgagtcgcggttttacattttatcttttgaatcagtgcttttaacttttttcattgtcttctcatttttataaaataatttcctggtggtgtttgtgaaagttccctgcttttgcttaccttggagaaggctttaaagaatgccctgatacccagttctcacaagagaagcaacttggtaacaaatcatcatctgaaattcagagcatctatcattttgattttcagtttgtgagtgatatttttgaaaaattatttattttggaaaattgttaaacatattcaaaagtaaagactaacataatcctcctcatgtccctgagaacctagtctcagcagttttgtttgtaccccctattcctcacatcctccaaacaccagattaaagtaaatccaaggcattcgtttattaatatgtctctctctaagagataagaagtttttaaaatatagctataatattcttattaaatcctaagaattaatattttctcaatacacaattttattaccttgttttataatgatctttttacagtttatttgattcaggatccagtcaaggctttcatattgccattggttaataagtcattttaagtctttataatttataatagtttccttcttttttttccttggccatttgttgttgtggttgttgttaaagaaattgagtcagatgttcagtaaaacaatccattttctaattatattttcatggtgtcgtatgacatgttcctttatctaaattttcttaaaactcctagttaaatctacaagtcttgatcacattaggtttgatagttgttatttggaataattcatagatgatactatgtacatctcattatatcacatgaggatgtgaatggctgtcttactgtggttgtaagcttaaggtgtttaggtgatatcaacatgatttccttcattataacgtcccctgtcaagcttttttttttttttttttttgagatggagtctcgctctgttgcccaggctggagtgcagtgacgcaatctcagctcactgcaacctccgcctcccgggttcgtgccattctcctgcctcagccttccgagtagctgggactacaggtgtctgctaccatgcccggctaattttttttgtatttttaatagagacagggtttcaccgtgttagccaggatggtctcgatctcctgacctcgtgatccacccgcctcagcctcccaaagtgctgggattacaggtgtgatccaccactcccggcccccaagcttttgtgaaatgttttcacatgccatttatgatcaaaatgcctagatccattgtttaattcagagtttcaaaaggatattattataattttgtcagtatttctgtatttattacatggagttatgttacaaaaaatgatttcccttactagctaataggttaccctaaaatacagcttatacagaaaatgtagggtaaatacttctcttgattcttttcagaagagttttttcaggagagatgatactcttacaaactccaaaggtgacaagtgggaagggtatatgtgtgtaatattttgaactcatagatttcagtatgagttactcttttcttttgttggtgggagccccctcaaattttctcctgtgttcttttgacatgcccctccaatatctttgatagctttcttgctttttgtgacagaattattctaatcttttatatatcttgtccaagacctgaaagtcattcatttctccaaggtggggcatacatttgaaagtgctgttttctcttggtaacagaaatatctgtgataccaccaagatatcttgctatatgcataggtaaaatgtatcttccctattggcactcgttaggtctctggttcctcattttcattgctctaaagaatgtctcccgttgctttggggtgttcctcatctccacaaagtgagtttctgtgtctcatatagttcatattttatacagaagttctcagtatttgtggacagcatctgtggattcagccaaccatttatcaaaatattcagggatagaaatgcatctgtactgaatatgcacagacttttttcctagtcattatcccctagacaatacagtataacaactatttatacagcatttatgctgtattaggtattataagtaatctagagatgatttaaaatatatagaagatttgcgtatgcaaatactataccattttatatcagggacttgagcatccattcccccacaaacactgaagaacaactgtattaggtattatacaataccatataaatgtattaaaatccacctttcacatgaagcgagtaacagaatagtagaagcttaattgtactcataagtagggcaaaatgcttttagcttggatagaaaggatagtttgagaaggtaaggattaaggaagataagagagtttgattttgacataatgagtttgaggtatgcagtatatctaattatttggtagaaaagtaacctccaggcctggagattaggtaaaattgttttgttgattctgtattgtttatcaatataaaattgaaaaggtgagagaataagtgacttgccaaagtaaggaaaaagtagcagaaccaagcattttacgaaagatatttagtagttgtaaatacaaatatgaaattcagaacaatttttttttcacacttttttccctcatctccttttggtgtgcctattgaaatgaactgaagatcttgtttttttcattagagtcccaagagtggcccaaaagagagaatttatctagaggaaaacccagagaaaagtgaaacaattcaggacactgtgagtatgaaatccatgcaatgatagtgctgtctttggctttccttatacttaaagtatggtatagacacatctgatgtttacatattttattttttattttttggaaaaaaaattaaaatttattaaagaaacttaataaagatttgaataagtcaagagatattccatggtttgtaagtattcttaggttccttcatatttgtcgtggtggtaacataaaatgtactagtttaaccatttttaagtgtatagtggcattaagtatattcacattgttgtgcgaccatcactgccaaccatcttctccaactgcaatttggtacccggtaaacactaagtctacatttcccccttccccctagcccctggcagccaccattctactttctgtctctatgaatttgactactttagatactcatgtaaaaagaatgatacaatgtttatccgttcatgactggcttctctcacttagcatatgtcttcagctttcatccgtgttgtagcatgtgtcagaatttccgtcctttttgagaccaaataatattccatgacatgtatatacaccacattttgtttatctgtccgtttgtcagtgggtacttagattgcttccactttttgctattgtgaatatgctgccttgccttcagtttttgtgggtgttcatcaagaagaagaattgtttgatcttacgtattcttaattgcatgcttttaagcactctgattttatcttctaattacatttatttacagttttgtagtaaaagatacaacagcattttgtcatctttttattgttagcaacataaggactattgaaaaatcagagacatcaaatcagttataaaatcaaaattgtctgactactgctcgaaactaatttatgttgtttcacctaatttcttttttttaattttttaatttttcctttttttaaagagggagtttcgccatgttggccaggctgttctcaaactcctgacctcaggtgatccacccgcctcagcctcccaaagtgctgggattataggcatgagccacagtgcccggccagtttcacctgatttttttttggaatattaaagccttgaggttaaagaaaataataagagttgttaaaaggcagaattgtgtttaggagactcaatatgtagtgttgcaacactaggaggaaaaactacaggtacatattattcactcagtttaaaacttgcggatctgtttatacaacttcagctatagccactataactgctgtgcaaatgactctcaaatcataggcctacccttctttgctgaactccatccagatcttgcaatgttaaactgctgttagatttaagccaaactcatttttttcctatttcttccaaaatttttattccccaatcctatatggtctttaattttagtacttatggtcttcagacatcctgtatgtatgtatgtatttatgtatgcatgtatttatgtatgtatatatgtatgaatgagacagagtcttactctgttgcccaagctgcagtacagaggttaactgtaacctcaaactcctgggctcaaactgtgtacccactttggcctcccaagtagctaagactatagacacacgccaccacgcctggctaatttattttggtttttttagagatgggtcttgttgtttttcccaggctggtttcaaactcctggcctcaagtgatcctccctccttgacctcccaaagtgctgcgattacaggcctgagctaccgtgcccagcacccatgtttattattttatatattaatgcctctgtactgccgtttttgtgctgaatctaactttgtgagttgacaaatggaggagctattgcatgggaaactatctgacaatctacaatttattcttagaattttgttatctttgtttctatagcagtgtttgtgagattacttgatgattttagagcattgtatcagtgatttttcaatcaagagtgattatgcctccgtggacatttgacaaatgtctggaaacgctgcagctggcatctggtgggtgcatagaggtcaggggtgctgctaagtgtcttagaatgcacgggctagaccctacagccaagaactctctggcgcaaaatgtcaacagtgccgcagttgagaaaccctgcattatacatttatgaaaattaattaaaaatgaaaacatagagttcgatgatagccttcaattatgtatcattaatggaaatcttgggttagtacttctcaggtatattagcctctctgctaactttgtcttaccatttctgctcttatttttcctttctcctattgtcttcattcactttttctttaattttttaattgtaaccatttatgtaagccaactttatttttttctgtaagaagttttaagtatgtatgaattaataaaagaatgtacagaagtgtacagaaagtgttaaagtcagataaccaagtgtatagtgagcaaaggatatttactgtttccaaggggagtggttttttccccccaaaaaaaactcgttgttgtggtctttttctctgccagagtggtacatggccttgaaaatttgtgaacccctactttgaaaataaagtacttcaaaggaaataaacaaaaagaaatctcaccatttaagtgaaccatgtctttttgatgggttggctttattctttttctaaatttgaccaccaggtaatttttctgtttcttttccctgaatgttgccaggacactcaatcacttgtcggaagtccctcaacccgtatagcacctcatattattggagcagaagatgatgattttggtactgaacatgaacaggtgatgacttttttctttctaaaaaatagattgttactttctgcaatatctgatttgttgcaaaaatgagcacgttctggagattaagataacatttgtaaggatttgaagctaaatcttagaaccaatagctccttgggttaattgcttattttagctttgaccaacagaaatgaccttgcttttaaagccagtgagagatcattaatatatgtttaagtacttcattttattggggttgagtgtgtttcttaaaatagtatttttaaaaaaaatttcaaatcccagttcattggtgctataaaggaatatgattagctagattcttgtccttgtatcctgtgatcttgctaaattcacttattatttcttggtgcttttaaaaataagtcttttggagttttctacatagataaatatgttgtctatagtttttatttccttattttcaagctgtttatcttttatttcttgttcttgcctttattgcactggctaggacttccactatgaggttgaatcagagtgacaagacatgcttgccttattcctgctattagggagaaaacactcagtctttcatcattaagtatgatgttagctataagtattttttagaggctctttataaggttaagggttattaggttaaggaatactcctggtttgctgagagtttttatcatcactggatgttgaattttgtggaatgagattattatgtggtttttctgattgtctattaatatggtaagttatgttgattgatattagaatattaaactagtctcgcattcctggaatgaacctcagttggtcatgatatgttatcccttttatatattgtcggtttcaatttgccatattttactgaggattttttacatctttgttgatgaaggatattggtgtgttgtttttctttttgtaatacctttgtctggtttgatagttgggggtaatgctggtctttagaatgatttgggaatatgaaaattgtgatgctagtttacattattattgttttctgtgttcagtatatttagggattatacaaatattctaggatttgtcttacttaaaatcatacaacttcatttcccaccatttctgcaattagcccagaagaaaaggataaacagctattttatgattgggcaaaaagccttccactgcatttctagaaatgttagactgttttttacatactgatttgtatacatccgagctacttgataatcgtctcctaaatttccgttctcccacagtggtctttcttctaacctatccccaagaggtggttaatgttcacagaaagagattccatagcttctgttgctaataaattttagtgaagttttttaaatcttgaattttttatagggagatcaaagtgaaatttggatagctatgttcaattgagcctactttgcatttagtatttgtatgttggagttactgatgcataatcatttcttcctctagatcaatggacagtgcagctgtttccagagcattgaattactaaaatctcgcccggctcatttggctgttttcttacaccatgtagtttcacaatttgaccctgcgactttggtaatatattttacaatctagcagattcagagttcttctgttgattcatgtgccatagaacttttcctagctatacaacgagtgggcagacttctttcagttttccgtataaagacagatacaaaagataattaaaacattatttttaaagacttggttatatagtaataactacattgtttatggtgacctacctgttccagacattcctactcaatggtgacctagcaaattacatttttcatggttcctcattttgtctttttcattcctttctccactacagctctgttatctctattcagacctgtataaacataccaattccaaagaaactcgtcgcatcttccttgagtttcatcagttctttctagatcgatcagcagtaagttgccaagttaatgttgtaatctttgccttagtacatggaattattgtcctcctgcttcctatcttccctcccatgtttttggattttactgtgctttctcacacctgtattatatttcaattattgattactctagacttttttttttttatcatttctaaagtagtttaggcatatgaattctcacagtaggttttaggggattatatatatatatatacacacacacacacacacacacacacacatatatatacacacacacacacacacatatttgtgttttttgcatgtgcataattagagtgaggaaatgaaaaagggaatacatatatattaagacccaaggaataatacttgaataactgaactctgggtggcctctttgaagtttggaggcataattttaactaaaaagtggcagaaaagatttcacttacactgaaataaatgatgataacgttatattttgtcattaaaagtgttaataaggtttttaaagtagtaagttttattattagtcttgttatgggtaaatagcacctagcccttaatgcatactggataatcatgccgcaggtccctagtcctttcacatttgcagttcccttagacgactgcctcatgctttttccctcctaaaacctccatcacttcctttcctagtcctttctcagctgataaccttgaccttattgtttctctgagaaatttaaagtatatagaagagaacttctaccagatgtatcatctgccctcattataccataccatgtactctactctttctcctgatgctatggagtgactgtcttttttttttttttttttgagacagagtcttgctctgttgcccaggctggagcacagtggcacgattgcacctcactggaagctctgcctcctgggctcaagtgatcctcctgcctcagcctcccaagtagctgggactacaggtgtacaccatcatgcctggctaatttttgtattttgtagagccggggtttcgccatgttgcccaggctggtcttgaactcctaggctcaagcaatctgcctgcttcatcctctcaaagtgctgcgattacaggcatgagccaccgcacctggccttgattgtccatcttttatccaaggccagctctgctccagtttacagtgtatttccttatacctactcaaagatcttactctaacaattatcctcccttctcctgcatcatcggttttatattttctacagataatcattcacattagtctgcaaatgttgttattttccctttctaaaaacaaacacacattttggctctacttctccctccaactcctgccccgttttctttgtatgcctttacaaaattgtctgtacactttcacattcaattacctactcagtgactttcctaaccaacctacttaaaatctcaaccctttcactttgtcactttttctattatttttgtccatagaacttttatttagttagttagtttgtttacacagtcagtcttctgtgcctgcagcttccacgaattcaactaaccatggttgaaaatattcaaggaaaaaaacaaaagccaataccacaataaaaaatgaaacaattttttaaaaatatagtataacaactatttgcatagcgtttacattgtattaggtattataattaatctagagatttaaagtatacagcaagatgtgcataggttatatgcaaatacagtgccattttgtacaacggacttgagagttcgctgattttagtatccatgggggttcctagaaccggtaccccatgtggatatcaagggatgactatattcctactctcctaccctgaatataagttttattaggccagatatttttattctgtttgttcactgctgtgtccctaacactgaacagttcctgggacatagcggggtcacttaagtatgtgttaagtgaattagtgttctgatcctactcccattgtttaaaatattgtgttatttttattaaaataatttactttcctaaaaaaatgacaatatattgaagcatgtttgaattttgcatttcttaagagggcaccaagctaagtcaaaactttacattttgctacacatgatctatatatcaatattaaagtataagaagaatccttacactttgattaatttgctaattatacttttatgctacagctcacatttatttcatatatacaccatcatacagaaatgagcttttattacttttttgcacttgagctagaaatgcttttaagaaagttgatttgagctactgcctgtcaaagagaaagttttaaaatccattttacttttcttcaaatgaatataaagagatcttacaatttttagcggtgacttattttcaaatttaaaacttcagatcttataggatgtgtttaaattctgaaattgtatgacttaaataggtatacaatacaaaataagcaggaagaggttaagatattttctcttaatgcaaaataataaagtattcccctccattagtttgggggtgggggaaaacaacagactggtaattattatgcaaatattatggggaaaatcctagctaggaataagtaaattctaagatagtcaccttatttggttcagtagcaagaactgtagatggttgctggagatttaaaactccaaaaactcaacattgacattcaatattttctcactgggagtgtgacattgtgagggctcttaaactttacataggaaaacgattaggaatattattggtcttcagaatgagcatctcaaatataggaaagaaaaatcatggctatatgtgagtacatttttcatatgataatatacacataatttaggttttacctatattgatctaaatgacatataactgattatattgaccaatgattctaggaagccaaagccaaagccagtatattcattaagtgtgtcacagaagcattcagtcatctagctaaacgactgtagacttttcctttatagcatgatcctcgggaaaagggctcattttcaagtttaaacgatagaatgttctggagttgtgaaatgtgaatgaataaatgagcttgtacttgattgtgcttgtagagtgggtatccaagttgtatccccttactttacagaagtacttatgtacatcttcaaatatctttagcgttgttacaccttttgtttgcatttcattttagcacctgaaagtttctgttcctgatgaaatgtctgcagatctaggtaagcttggagcactaacatcctggagaattacatcttaatagatatgtagctcagctcatctgttcaggttttatctgtcacatggtgactagtcgatcacctgaatcacaacagaaagacagtctataatacatttaaagagtaaatgaggccgggcgtagtggctcacgcctgtaatcccagcactttggaaggccaaggtgggtggattacctgaggtcaagagttcgagaccagccttgccaacatggtggaaccctgtttctactgaaaatacaaaaatgagctggcatgatggtgcatgcctgtaatcccagctacttaggaggctgaggcaggagaattgcttgaacacaggaggcggaggttgcagtgagctgagattatgccattaacactccagcctgggtgataagagcaaaactctgtctcaaaaaaaataataatatggctgggcgcagtggctcacgcctgtagtactcccagcactttgggaggccgaggcgggtggatcacgaggtcaggagatcgaccatcctggctaacacagtgaaaccttgtctctactaaaaaacaaaaaagtagctgggcgtggtggcgggcgcctgttgtctcagctactcaggaggctgaggcaggagaatggcatgaaccccggaggtggagcttgcagtgagctgagatcgcgccactgcactccagcctgggcaacagagcaagactccatctcaaataataataataataataataataataataataataatagagtaaatgaaatcagaattctgggatgaaatatacgaactgccctgaagaacttccctctggcatattctaagttaatttgtacgaagtagcattgctatgttgccaattgtatgttgcccagaacatacctttagataacataattcctttcatttatgaagaaaagagaagacctgagctcattcctgaggatctgcatcgccactatatccaaactatgcaagaaagagtccatccagaagttcaaaggcacttagaagattttcggtaagcttagtggtagatagaatttcatatgattattctaaattaatttttttagttaagaaaaagttgctcattaaatacttagcttagcactagataaaccatatggtcttattgttattaaaacataatgaacatctggagccaaagggttagagtggaactgagagtccagactctccattccaggcacttgcaggatctgagctcagtgctgtgtctatgctaagtgtgttcctttaagatattgtatgtgttcttggagtcattgcttctagaattttttcctctggtatcctagatgacatggacccataagtggaaaagtgacatttttcctgttcctagaaaccatagctgtgaagactgtgatgaagcgtccccagaatgaggtagtttttctttaggctacctcaggaaacttctctattcccttcaggcagaaacgtagtatgggactgaccttggctgaaagcgagctgactaaacttgatgcagagcgagacaaggaccgattgactttggagaaggagcggacatgtgcagaacagattgttgccaaaattgaagaagtattgtaagtaatagaagtatatgtggaaatgccctctctgctgagatactagttatgcttgaagtgtcctttgggtaggtttagaaaaactgtcagattgtgtatgtggagccgtttattttgtcatagtacttgagaaactggattttttttttcttttttctgatacttttagataaatttcttgtgttcctttttctgggtggtggtaaatgggtaactctaaaacttctaatcagtgatcaaaaacaggttgattactttcattattttcaatttataggccttggaaatatttcttgccatgaagcatatacagttggtgacatgagggtgaaacagataaggttctttaggggatcagggttcttttggtattttattctagggtgtggcccaaagcatttggctctgttctgttatttcaggtatctgagttaataacaatttttaaggccaggcatggtggcgcactcctgtaatcccagcactttgggaggccgagcgggcggattacgtaaggccaagagttcgagaccaagctggccaacatggtgaaaccccatctctactaaaaaccccaaaattagccaggcatggtggcactcctgtaatcccagctactcagaaggctgaggcacgagaatcacttgcgcccaggaggcggaggttgcagtgagccaggatcatgccattgcactccagcctgggtggcagagtgagactctgtctcaaaaaaattaattaaacttccatatttcatttttaaatttttttttcttttttttaaggatgactgctcaggctgtagaggaagataagaggtaacataactgttttttttcccctagaattttaagaaaaaaagaactatgtttttttcctttcagtcctaaattacaatttatttcttttaacttacaaatacagtttgtggtctctctctggtggcttgtatgttatttgactaatattctactgttgtcctgagtagaattctcttctctgtgcaatgactagttagttctttagtgtttgtttgatttatttcaataattccaaccttggggttttggaaatcatttgatgtctttattctaccaaccctcccttctcagaagtcttaatttacttcgtcctttctcctccagctccaccatgcagtatgttattctcatgtatatgaagcatttgggagtaaaagtgaaagagcctcgaaatttggagcacaaacggggtcggattggatttcttcccaaaatcaaggtaagaatgaaataatgtaatagcatgttcaggccttagggcttctttacatttggttgcagtgtcttccatcatcttagtatttacttaatcagcaaattaatgctagtcatacaaacatttataagatactgtctctgttctcaagaaactcaaaatacagtgagaaatccagacatataaactattattagacaatgtgaaaagtgaaattagcagtttacaaagagtgctatttctgattctgttcatgccttatactttccttttactttgcctaaactaaataccccctgtgttgctacataatcgtcatgaacatctttagtggcagtagagtattctgtcagtttgtaattatttgtgtttttgtttagtgtttactagattgtaaagctgtatgagtacaaggaccttctttattattgtattttcaactgttagcaaaatgcttagtaaatatttgttgaatggatgaatgaattgtttagaataagttcctggtaaatgtgctataaaactaccctttgattttccaaagctgtcagtgataaagagtttgaagaaaacatcttgagtttgaggtgtacacggtactgtgtgcgaacttttaattagtgctctgtgtgcatacacacgtgtacgggttttcatttacacttaacaatttctttgaactaaccattagcattacactatgaaaatcgcaaaagaaatttactctgttacgtatctcttattttttgtacttcaactctagcaaagtatgaagaaagataaagaaggggaagaaaaagggaagcgaagaggattccccagcatcctgggacccccacggagaccaagccgtcatgacaacagtgcaagtatgttgaagtttgaagtgctgcattttcagtactccaggccctcttcacatcagaggcttcttcagctagaatgaatttctggagaaaggagttgttaggatgattttactgaattcccaatatgccttgtttccattcagcgttatttctgaactaagtaccccctatgttgctacataattgtcataaacatctttcgtgggctgggcgtggtgattcacgcctgtaatcccagcagtttgggaggctgaggcaggcggatcacaagttcaggagatcgagaccatcctggctaacacaatgaagcctgtctctactaaaaataccaacaattagccaggcgtggtggcatgcgcctgtagtcccagctactcgggaggctgaggtaggagaattgcttgaacctgggaggcagaggttgtagtgagccgagattgcaccactgcactcaagcctgggtgacactggagcgagactctgcctcaataaaacaaaaagaaaagaaaaaaaaaaaacgaaaacacacatctttagtggcagtattctgtcaaatgtccgtaacatagtttacttacctcttctgattctgtttccattcaacttgtgtttgttaaattaaaaaaaaaaagtgtgtatagatctctccaccacactgaacgtctctttatacatatttacttagtctccatatttctaaaatttctccacctctccattgtactttattttctgatttccctttcaccccaggcccaataaagagagataagctcacttgagatggctgcaggagaaatagggatggtggtaccatggggaggggtcatgtgatggttcttatctcaggcagtagcacatttgaaaatactgaagccaggtgcggtgactcttgattgtaattccagcactttgcaaggccaaggcgggaggatcacttgagcctgggagttcgagaccagcctgagctacatagtgagaccctgcctctacaacaagaacagccaaaataagctgtgtatcatggtgcatgtgtgtagtctgagctacctgggaggctgaggtagtattgctttagtctggggagtccaggctgctgtgagccatcatctcgccactaaactccagcctgggtgacagagtgaaacactgtctcaaaaaaaaaaaaaaaaaaaaaaagatattggcatggtagagtggtgggagtaggattgtgatagtgagtgtcccccacaatgacgagttctccctcaaatgccatgagtgcctcttgttgagaaacattgagaaggtgtgaaatttttagaggaagttaaagagatggaggatttcacagatgctaaccgtgagttccaaggtatacaaaagaagaatttgaggaattaagagattagggtataaaaagttgtgtgagggtgtaggatgctttggatattgaacacctgagtgggagtctttggcttcttgtggtgactttgtgaacaaggataattagcaggatggggattggtctggatggtctttgaggtacattatgatgatgaaggtgtgagtgttgggggagaactggggtgggagcttactaagaactcacaaaaataaagacttcatcttcattcttacaaatgaacacagctccatgtctctcagcattcctcctccctctgtccaccattcctctccttcttttctcatgacccttcttctttccctacatcctcctcttcctcgctttcgtcgtcctgcctcacccctcctccatctcctcatctttctgctctaccttcctctccctttctctcttttcttcttccttccttcatctgtctgtctgtatgtttctctgcataacaatccactatatatattttttagggtctaccatgtttcacacattttaccagattcttttacattgtccttttttgcttttagctaatttgcaatgcagattattttatttattttatttatttatttttgagacggagtcttgctctgtcacccaggctggagtgcagtggcgcaatttcggctcactgcaacctccgcctcccgggttggagcgattctcctgcctcagccttccgagtagctgggattacaggcatgtgccaccacgcccagctaatttttgtatttttaatagagacggggtttcaccatattagccaggatggtctcgatctcctgacctcatgattcgcccaccttggcctcccaaagtgttgggattataggcttgagccaccgcacccagccgcaatacagattattaaccatcattttctgatcagttggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggtgagctattactgtagttcagcttaactaagcatcaagattttaaaacaaacacactaactgaaaaatagagtggcaagttaatcaagactaaatcccagtttaatttaattttgacattttaatatgctacaaccaataagaaatctatgccgaatgataacttaagttctcatttgtccaaaaaaatatttattaagctctctgtcaggcattagctttgtcccggatgttaacatgcaataattatacacagatgcttgcctcatgcagctttctctcttgagagcgatagtcacaaatgtaaaaaatgcaaattgtgccaagtccaatcaagggaaggtaaagggagtattgagggaactggtcagtagttagaggcagatgtgggtatctaaagaagactttttaaaaatctgagattaactagaggttttatttttcaatgttaataggaagccagctgaaagaaagggtagaatatgtgggagacagtatataagtagtagaacagagttgtgaggagagaggagatgagatgtagagtgtatgtaaagggtaagactatttactgagagtgagagttcagtgagaagagcaagggaatttgaagagtaaagaaagatatgaagcaatcgtaggtaattgggcaaggagcttattaccatgtcttcatccttgtttgggaggcggttcaatttctggtggtgacatgatcaagaatgaggctctgggagtggtccctgaggtgccatagaggaggctactagggatgaagacggcaaggaaccaagaagccaggagtttgaatagcttaatattcatggctagtgacgtcaccaagtgtgatttttatcatggagaggaaaactgtgagccaccagccaaaggtttagcattgctagatgattgatatgaggaggaagagaatgtgataatatccagagcatgagagcctcagtggagcaagagattatacaggaagacaaggtcgggtgcagtggctcatgcctgtaatcccagcactttgggaggctgaggcgggtggatcacctgagatcaggagttggagagcagcctggccaacatggtgaaacccggtctctactaaaaatacaaaaattggccaggcatggtgacatgcacccgtaatcccaggtcctcgggaggctgaggcaggagaattgcttgaatccaggaggtgggtggaggttgcagtgagccaagatcgtgccaatgcactccagcctgggcaacagagtgagactccatctcaaaaaacaaaaacaaaaacaaaaaaaaacgacaagataatggtccaaaaatcatattgaggaacaagaaggccattcatctcatctccaccctgacatacaccatataagacagaaatattagtttctgtctcagagggctgtagcagaagaggtaagctgctgggaataggcaggtttctacataaggccaagaagtacaagtgacatttggagaaaattctggggattttgtcaaatatggaactctgaagatgttagattgggtatatgcactgatatttcatggctcctgtgacttattaaaataaaaacatggtaggtggcggatgaacagaaaccataaagagaaagaaagtagaggaagggaatgtgttatcaggaaataagagattttaacaaatacttgggagattgaaagcagacaagagtgtaaagaagccaggcatggtggcttactcctgtaatcccagaactttgggaggctgaggcaggaggattgcttgagcctagaaattcaggaccagccagggcaacatgaaaagactgtctctacaaaaaatgaagaagtcagccagtcatatggcatgtgcctgtagtcctagctaatcaagaggctgaggtgggatgatcacttgatcctaggaagacaaggctgcagtgagccatgttcttgccaccgttaatgcagcctggatgacagaatgagaccctatctcaagaaaaacaacaacagagaaccacaagataaaaccataaaggaagccagagcccacaatttgtttaaacagtccaagatagaacccagtctgctcattggaaccctggagagactttgggctcagagttagcatatgttatgcagtgcaggaataagaaaaagagcaaaaatgatgaactaattgcaggtctataatcaaaatagttatatcagcagcttctaatccctgaattacagagtatgagcagtctctgtcacttgtagactagaagaaaaaaacagtgctcttttttaaaataattcagtgaattgtgtagggagagttaagtccctccgcagtattgatcgcttggagttctgacatttgggagtccaaagcctgacactaggcatgccggcaacccactgtgctcagagagctctcaactgaaacagacctattactatatagcagcaaaagaaagccaagtcagctactcactttcatcattaaacacgaacatcattactcacccttgtcagagtcaagacgtaagataatatataatgccaaacatatcagacaatgacataaagagagaatacagttaaacagaagaattttccctacaagagaaagataatctgataatagacaagaacttaagaaaatacttctaaattaggtagtatacttggggacattaaagaagttattatctctataaagcaagaatagggagcattcagagacaaaatatttttaatacaactattaaacacagtgacatctgttgtattatcaatttctgtgtgataaattaccccaaaacataatggcttaacacaaaaaaaatttatctcgactttttggtggatgaaggactccagagcagcttagctgcgtgggtctcggttggagtctgtcataaagttgcagtcaagatattagccagtcatcagaaagcttaactggggctggggaacccatttctgtgcccactcaggtggctgttggcaggaggccttagctcctcactcatggccttggctccttgccacatggacttttccatagagatacttgagtgttccatgaaatggtagctggcttttcccgagtatcccaaaaaagagagcgaaaaggaagccccaatgtcttttctgacttagtctctataggtgcactctgtcacttctgcaagttagaaacaagtcactaaatctagcccatactcagggagggaggaattaggctccacccctgaggggagaaatatcaaaaaatgtgtgggtatattttcagaccaccacagcgatcagagtttaaaggaaaaaaaagaagtccctaaaattaaagtcaaggaaatattttagagtgtacatcagaaatatgaaaggatagaaatttgagagaaaagaattatatagggaaccactacagagagccaacatctgtctctttcacaaaaagtcagctgaggacatggagaagagatggttaaacaacaggagaaagtttcccagagttgaaaaagaatacccatcttcaggtggaaagggctcactgagaaccatctatagtgaatgctttttaaaaaatccattcctaacatgtcctttgaaactgtagtgcaccagggataagctttcagaggaaaaaaaatggggattacactgcatcacattcctcatcataacactggatgctgaaatacaaaagagccatgccttcaactttctgaaggaaaatggttttgaacttagaatcctgtatccatccaagctattcatcaaatatgaagaatgaataaagacattttcagatacacaaggtccacagtttaactggaatgtacctttccctttgaaatcatttgaggatacacattctagcaacatgagaggaaaaattaagaaagaaaatgtcctgggatccaggaaacactggaaacacccaggaaagtggcaaagggcaattctaaaatgatggttgtgtaacaggccaggagagccactgctccagattggaacacaagaacatcacagataagaaaatggggattttaggcagtggatagtatgaagcagcagaggaaatagtttgagacttgatagaattatataactttgacagcaataaaagaaaagcatttagaaatgttaagaaaaacagaattgttcaggaaaataagtcatgatttaaacatgaagcaaaataaaaagtggcatgatctttagcaattgatggtgtgtaagaaagactttaataaatgttctatttgaagtggcccatggattgcatcattggaccggtaggaaaaaatatataatcctaactagtatatttcttaatctggcaggaatgatgtatatatgtatgtagtagacgacagtatatatatgtcataagcattctttcttggttttcagacttttagaataaccctaccaggcaagcatggagtagttcattatggctgcaggttagaatataaatgtaaaaaattcttttaatgatgcaagtaaaaatgtagttgaaagaaatggaaggtagaaggaaggaaatacaattagagggaggatgtggacactgaatacctaatctgacacagaagagagttgagatactaactttttgatagaacaaaaacatagacatgtcatttaaatttaggtagtaactaataacccagctagtaataatgataaaactattaaacattgggaagaaatggtagaaaagtgaaagtggaaagtgtaagtcaacaaaatcctcagaggggaaagaaatagatattaactaaagataataaatcatgaaaaagaggttatttgtagttggaccactgtaataactcacatttgaaaacatgaaaaaggattgatactgggagtagaaaaggataagatgggaaaatgttgttcctcatcatatactcttctgcactgtgtgagtccttgctatttcttacgttaatttttaagaaacagttttaaaaattatttttctgaccaggcatggtggctcacacctataatcctagcactttgggtggccaaggcgaaaggattgcttgagcccaggaattcaagactagcctgggcaaagtagcaaaaccctatctctacaaaaaaattaaaaatgagccaggtgtgtgtggtggcacgcaactgtaggccccgctacttggaaggctgagatggaaggatcatatgaggctgagatgggaggatcatgtgagcctgagatgccataattttgtatattaaatttttagttctagtgaacctgcagttgtttaaataagaatgtagctatggattaggctgaagctgttctgggaactaattttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttcgggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatggtgagtgtaatcaatttgttgttgttgtttacaaatactgagttttgtcagagtgaattaagtctctcagccttggagtttgcttcaaagtttctcctagccttttgttttaaacaaagaggaaattaaactggacagataatccttgaactcaagaaaatgcaaatgtttctctgattcttattgataatttaaaaggaaaatgtgttaagccttaaagatatttaagattcatagcattatagatcttaaagttgaaaagtcattgcaacaactaagttatttttatgcatagattttaaatgaggaaggtaaagcccagggagattgaattcgttaagatcatacagctaataacgtgtaaggaaaaaaattcagttcctggtctttctgtatcgaagtgcagtgttctttatttaccctagcatgtatgtgataaatgtgtggcatgggtgctgtaccctttactatccttagcatgtgatatgaataaatatcttgtctctgacaatactgagacataatgaaattataagcctgaccccagaagtgagtgtttataggcaaattagataaccaaaagtactattatttcttaagagggctcaagttaaaggctatatgatgttggggcttacagttttcttaatgatgtagttgtgataggtgggtattattgtaaacagctggatgtgtttgggaatacactaaaaaaaatagttttgaatgatattttttatttgtcagtattcaactctcagagccagtatgtaggaaaatttcttggaatcagaatgacttcagagatatttcatcctttctaaatgataaataatttattatataattcatttgctacttcactccagctaaagactatgattgatcccatggaattgttctaagtaaggcaacatttcatatctctttcctgttcagaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatagtaagagaaattagctctgatctttgcccctaacatttccaatagagaaaagattgtgagtttaaaattttgtaaatgtacccatgttagtattcctgagattatgtgtgagaatgtaagataaataaaggaatgattggaactttgactagatccttttcctcacaatcaatctttcatgtacaatgtgtcaacatagggcttccagtctaaagtcattgcctaaggtgaaaaacatgaatagtcaaattcaccgttgaaaattttctatcaattatagtatatatatctctttaaatatatatatccaatataataatatacgtataaatgtgttttgtaaatagtagtgtatggtatataatcacatggttcggtaatttttaggaattgtttttatttttttgagatggagtctcgctctgttgcccaagctggagtgcagtggtgcagtcttggctcactgcaacctctgccccctgggttcaagggatcctcccacctcagccacctgagtaactgggattacaggcgtgcgccaccacacccagctaatttttgtatttttcgtagagatgggtttcaccatgttggccaggctggtctcaaattcctgacctcaagtgatccacccgcctgccttggcctccaaagtgctgggattataggcatgagccactgccccggcctcaggaattattttattgttttgttgcttggaacacttgaataagtatataaaaattctaccttgttgacattttattggttgaagtcatcttggacttttgtggacagtaatatgatgttcctctcatttataggtcactatttctctatgacccttaatttttttatctttctttttcatgtcatcactaactatcaacatctgctaactaaattgatgccttttattcctttgtggataatcttgggtttcacaggcatgcattgacaagttcaggcttgattacatccattgcctgcacacttaacacattttgagaggatcagtgaacagaattacttgtactgtttaaattcaagttctttttgagcatgattatagatggagtcttgaggttcaatgaatatttgatgcaaccaccgtgtatgtaatgtgctagtttccaaaaatgttttttgtttagcacctgtttttcagatagagcttataatatccagatgtgtaagcactatgtccagatttatatttaaggagataagaagcagctgtactactgtgaaaatcgtctttataaaaaaaaaaaattagctactctgtactaccagtaattctgtctacactgaatgtgttactaacgtttttctatctttttatctttagttggattgaatgaacaaatgaaggctgttcgaaagagaaatgagacctctgttatcgatcagattggggaagatttgctgacatgggtaaggaaattttctgtttctttttaatatttttatggacacttgatggttagattcaagttgagtaactaacctttccaaatatgcaaactcatccatgttgcaaagttaatgcaaagctgagaaaggtcaagcagtagattccatttcaagaaaccacctgttttgctcatctgtaagaagcagacccttatccattaaaagtcataccatgagattgcagtgattcagtcacaccttcaggctccactgtaatcctagtttttttgcagttacctcttccactgaagtcttgaacccctcgaagtcacctatgagggttggaatcaacttccaaactcctgttaatattgatattttgacctcctcctgtgaattatgaatgttcttaatggcatctagaataatgaatccttttcagaaggtattcagtttgctttgcccagaccaatcagaggaatcaccttatgaaatatatttcttaaataataagacttgaaagtgaaaattactccttggtccatgagctgcagaatggatattgtgttagcaggcctgcaaacaacattgatctccttgtacatctccatcagaagtctttaagtgaccatgtgcattgtcaatgggcagtaatattttaaaagtaactttttttttttctgagcagtaggtcttaacagacatgctgtcatctaggctttgttgtttcatttatagagcacagacagagtagatttagcattattcttaagggtcccaggaatttcagaatggtaaacaatcattggcttcaacttaaagtcattggcccctaacaagagagctggcctttcttttgacatgctgaagtcagacattgatttctcctctctagctatgaaagttctagatggcatcttcttccaatagaaggctatttcatctacattgaatatctgttgttcagtgtagccactgtaatcaattatctcaggtacgtcttctggataacttactatagcttctactgctatatcagcacttgctgcatcactttgtacttttatttttatggagatgacttcttttcttaaatctcatcagtttacccctgctaccttcaaactcttcgtctgcagcttccttacctctcagccttcatagaattgaagagaattaggggcttgctttgtattaggctttggcttaagggaatattgtggctgatttcatcttctttatacagactaataggctgtttcactttcctcttgttcatttgttcattggagtagcacttttatttccttcaagaattttttctttgtgttcacaagttggccatttggcgtaagagccaaatctcagcttttgacatgccttccttactaaacttaatcatttctagcttttaatttcaagtgagagatatgtgactcctcacttgaacccctaaagaccattgcagcattgttaattggcccaaattcaatattgttgtgtctcagaataaggaggcccaaggaaagggaagagagttgggggaatggtcagttggtggggcggtcagaacacacacaacatttttccattaggtttgccaccatatgtgggtgcagttcatggtgccccaaagcaataaatagtaacatcaaagatcactgatgacagatcaccgtaacagagtaaaatgaaacagcttaaactattatgagaactaccaaaatgtggcacagagacatgacatgagcacatggttttggaaaaacggcaccaacagacttgctcagggttgccatcaaccttcaatttgtaaaaaatggagtatctgcaaagtacaataaaaatgtgaggtatgcctgtacctgtaaaaagttgaggaaaagcagaatggtggtttgtaactgtcacatacaaagcgttaatttagaagaaggcattggccagaaatcataaaagcaaaaatcataaataggcctttagattttactcttgctgtttaaataaaatcattttggaaagtatttttccagtattgtttccttaagatcactttacatacacagacaatccttgacttactatggttccaacttcgacagtttttttactttacagtggtgggaaagtaatacacattcaatagaaaccatactttgaattttgaattttaatcttttccggagcttggcaatatgtggtatgttactcttgatgctgggcagcaacagtgagccacagctcctggtcagccatgtgatcacagggtaaacaaccactctacagtgtactgtactgctagatgattttgcccagctgtaggctaatgcaagtgttctgagcacatttaaggtcagctaggccaagctatggtatttggtaggttcagtgtattaaatgctttctcaacttaagatattttcaatttttgatggttttattaggatataagttcatcagaaatcaaggaacatctatacttaaactgcttgtaaaactactgtagaggccgggcgcagtggctcatgcctataatccctgcactttgggaggccgaggcaggcagatcacctgaggtcaggagtttaagaccagcttgaccaacatggagaaaccccatctctactaaaaatacaaaattagccaggcatggtagtgcatgtctgtaatcccagctactcgggaggctgaggcaggagaatcgcttgaacctgggaggtggaggttgcggtgagctgagatcgagccattgcactccagcctgggcaacaagagcgaaactcagtctcaaaaaaaaaaaaaaaaaaaaaccaaaaaaaactactgtagaactgcttgagtttgggggcattattttctttggtaaacccagctgctttttgtagttgtgtggtgctttgattgactaacatgctaaaaatgctgccagtctccttgttaaacatgttaaatgtcatattcatcatagagtaagaatacaaaattggagtgacctattaaaatattgctttgtatgtgtcctacttgaaaaaatactctgaatttatctacaaatgcgctacaggcgggctttttacaaaatgcctttatgtacaaacttttgggaatatggctttaaatggaagattatatggaaaacatcttcgtaaaccataaagcaattatctacaagtatagaggctgtattaaaaaacaatgtatttgacttctacgagcacctactagtaaatcactttttaggtgtttaaccatcagaaatcttaaaatcatggcacatgcaaacttaaatttacaaattaaaaaacattagtgagaagtataatttttagcaaaagaattcataagctcattgatctcccccaagccagctccagctgctgcacaggtgaaacagcagtgatttaattttgtttcaacacagaaaacttacggcctgcccatggtcatagtgggttttatactgagtaagaaggaatgctagtatgccaaggatttgcttcccagagtagtaagacagtagttgttgtaaaggcttcagggtgtaagaaaattaaattttaggccagatgtagtggctcatgcccataatcccagcactttgagaggccaaggcaggcggatcacttgatgtcaggagttcaagaccggcctggccaacatggtgaaaccccatctctactaaaaatacaaaaaaaattagccaggcgtggtggcacacgcctgtagtcccaactacttgggaggctgagacaggagaatcactggaacctgggaggcggaggttgcagtgagctgagattgcaccactatactccagcctgggccacagaatgagactgtctgaaaaaaaaaaaaatgaaaatttagtctcagtcttcaggcattttgtatcttatattctccaaatgtcagcttgtctgtgtaatttataagtaacgtaggctgaaaggtaataggttgtgataggctacaagcaagaaaacattgggactgggcacagtggctcacgcctgtaatcccagcactttggggacaccaaggtgggcagatcacctgaggtcaggagtttgagaacagcctggccaacatggtgaaaccccatctctactaaaaatacaaaaattagctgggtgtggtggtgtgtgcctgtagtcccagttacttgggaggcagaggtgagaatctcatgaacctcagaggcagaagttgcagtgagccaagatcatgccattgtactccagcctgggcgacagagcaacactgtctcaaaaaaaagaaaaaaaaaagaagaagaaaacattggaatatgatcagaaaaggtctggttgtgtcaagatcagacctttttaatggagaaccattgatattccacatagatatgcagttctgtgtattttgtcacttgaaatattgaaaggattctggttgtctgtcactttgtctggcttgtataagctcagtttcccattctcttttgtgttctttgcattcttggcacagttcagcggaccaggagaggagaaattgaaacatgctgctgctaccttttgcagtaaccaacctttcgccctggaaatgatcaaatctcgtcagaaaaaggattctcgatttcagacttttgtgcaagtgagttgagtgagtcatgtaagaaaaaaaataaggcaagtttttatcaattatcagataaactgggggaattctgactaagacttttacaaagattacatctgtgttaactttttttttttgagacagggtctcgctgtgttgcccaggctggagtgcaatggcacaatctcagctcactgcaacctctgcctcctgggttcaagcgattctcctgcctcagccttcctagtagttaggattacaggtacatgctaccacgccctgctaattttttctatttttagtagagacggggtttcaccatgttggccaggctgggctcgaacacctgacctcaagtgatctgcccacctcggcctcccgaagggattacaggtgtgagccactgcacctggcccacgttaacatttttaaaagcaatacattatctcttaaattcctggaaggtacaaaaatgactttggaatggtgaagaataataaaaaatatatgtcaggattaaaatacttaatatagaaatccacattgccacgaggcttttatcagtaaacaaccgtatgctctattaagagaatattgtcaaagcatgagaatgggtttatccagggaaaaacgtaacagcagccacactcattggggtatatgaattaagggttggtaaactatggccgacagaccatatctagtctgttacctgtttttataaagttttatgtaaatacaaacatggccgcttgacagatttctcacagttgttgtggtgtgtgggtatggtttagcaggttcctcccttgagagtttgaccaggctgagatcacagcgtcagcgggagctgcagttttcatctgatgctcgaggttctcttctaagctcactggttgttagcagagttcatttctttgtaaatgtataactgaggtcctaccttgctagctattggctaggaaccagtttcaactcctagagaacagagagatctctgccatatggccccattaggcagtttagaggtggatgtttgctttcttccaggccagtaggaatgtggctttctgacacagatttgttttaaaggctcctctaatgaaatcaggcccagccaggataatttcctttcttatgatctcaaaatcatgtggtggcaacctaatcataggtgtgatatcccattgtaatcacagattccaaaaatgttcatactcaagggcataggattacacagagtatttacacaagaggatgggaaccttggaggccatattagagttctttactacacagagccttgttcattcacttatgccaaaacagtagagctgaatagttgtgagagagactatatggcctgcaaagcctaaaatatttactatctggcattttactaaaaactttgcagaccactggtatagatgagctggcatactcgactggttatccattgtgcatacttggaatggcagataacaaattagctaaccaattttggtaggaatgtcaatcataggagaatggacctagattttctgaataggtgaagataaaactgtttcaacacaaggaagcgatacgtagagctgcttatggatgctttcagtccttccttaaacagataacaagccattcatttagtaatagaggctcccttcccccattatgtgattaaaggagaaagcagaagtatattgtggcaatgatatatcttggcattttttaaagatcttgatttaataaccagaactgtgatgcattaaaccctcacggtgaatacatggtacatgtataagttcaaataagaattacagattcacttatttcactttaattttaggatgctgaaagtaatccactgtgtcgtcgtcttcaactgaaggatattattcccactcaaatgcaaaggcttactaagtacccacttctgttggataatattgccaaatacacaggtacagcattttcactgaaataaaaagcttaagaacaacaacaacgaaacacccaatatcctgtaaataatatcttacagcgtcctgaatggagttggatttccaaatagtatgacaagattttctttttttttttttttttttccttttttgagacagggtctcactcagtcttgcaggctggagtgcagtggcacaatcatagtttcctgcaacctcaaactcctcggctcaggcattccttccacctcagcttcccgaacagctgggactacaggggtacaccaccacacttggctttttttttttttttttttagcaagggtctcactatgttgctcaggctggtctcaaactcctggcctcaagcagtcctcctgcctcccagagtgctgtgattataggcatgagtcaccatacccagccaagattttctaacaagatatgatctagtcttcttcgggctgtttgatataatgtactccattagtagctttagtacggggtatatcaaactatgaatcatagaccaagtcatgctcactgtctgtttttgtaaataaagttttattggagcacagccgtgctcgtctgtttatgtactgtccctgattgcttttacattataacagcagagtcgagtagttttatcggtgcccatttggcctacaaagtgtaaaattatctggttcaaccatccttgttctagcctgcatcatttttgctttgaagaaggttcatccttggctgaagagatgtttcatggatatctatcaatgacttttattaagccaaatcaatgcggtgtaattccaactctcccgttttgaaacatgaaatgaatctgtttctcagctgagctttaggttcttatacttagctctcattaataatttaatgcaactgaaatcttgtttcttgtgcctgagaatttgaatgcataagcaggaaattttaaattatggtacctggtaacaaaagtggtttacactcatacatattaatttttacactttaatatatctgctcagtgtagttagactgtggtttggaggattataattttgaatgttctgattttggtcttctttgtattatagacatgacatagcctcaatacgttttgtcttgttttgttttgttttgttttgtttttttgagacggagtctcgctctgtcgcccaggctggagtgaagtggcacaatctctgctcactgcaacctccacctcccgggttcaagcaattcccctgcctcagcctcccgagtagctgggattacaggcgcacgccaccacacctggctaatttttttgtatttttagtagaaacaaggtttcaccatattggccagactggtcttgaactcctgacctcaggcagtccgcctgccttggcctcccaaagtgctaggattacaggcatgagccaccttgccttgccgcctcaatacgttttgatgaatttcatcttcttttaatgtaatctattttctttctttaaatataatctcaaattcaaagaaacttgttttggaattattttgaattgtgttattaaaaaattttgtttaacaagttcactggacataattatgtaggctatgcactgtgaaattctgaggggagaagggatttccatttatattatttacaaagtaaatgagacctgcccttctggagtgtatagtatagtggtcctggtacttcacgtaaagcatctcttcttggatttcgggttctgtactgtgatttctttttaaagattagaatttatgttttaaagtcctgttataagaagttttacctgtccaaagactgcttgaattgagactctgacagaggctttaagctggtacaaaaatcttcaaggtcttaatatgctcttaaaagtattgaaatgaaatgaaatctcatttacatatattttatggttttttgctcagttcttttacattttggatttctttcccatatttagaatggccaacagaaagggagaaggtgaagaaagctgcagatcactgtcgtcagatcttaaattatgtaaatcaggctgtcaaggaggcagaaaacaagcaggtaaaaaaggaaaacaagaaggtacaggatgacattgggagaacattaaattaatattacctggaatctgtgaaatagttgttaaaactatcattacctaatggacagggagaacatttgtttactgttcgcatagtaggcaggtcaagatcaatctgtgatagaatatcggagttgtatttgactttttgaaacacctcaagctgcttgtttgctctttcatttatctcttcattcagcagatatttatagaacatctactgtatgctgggcatagggtacagagtagttgagaaaatgagtgcaatatctgcccacactgagcttgtttgctaggaggatagaaaggcatttaacaggattatagtgcaaatattttgtatcagttgtgatagctactatcaaggataatttcaagatgctacgatatataactatggggcctagcttagtttggggatgttaggtggtgcctattagagaaaattttcttgaggaattgacacttgagccaagctctgaaggatgagtggaagtgaaccaaaatgatgtgaagggtgcaaccctagaggtagaggcaatatataccaaagtcctgacggaaaaagaaagcatggtctgttggaagaattgaaaatttacatgagtgtggatcatgcctaaaaagcaaagtcagagtggcataaaatgaggtaaagtagaccaaggccaactcataaaggccctagagatcaggttaaagattttgatttgtcttcttaagtgcagtaggaattcagcatagacaagtaagaatatagtgttcagattttcattatctgaactagtactctatggagaatgagttgaagaagggtggtggatgaaagagcccatttattaacctcttgcagcaatctaggatagatgatggcagcttagagaagttggagaagtatttagaaggtaaaattgacaggacttgatgactgatttgaagaaggatttgaaggaaaagtgatgtcaagaataaacccccaggtttctggattgcatatttggatggacaggatgagtggagaagccccacgtttgtggggaagatgatgaggtcactctgggatatcaggtagacatgcacagtaagcagttggctgtatgggcccacctctaagaggaccatgttgaagataaaaattcaagattgtgagcatacaggggctgattgaatccgtgaacacggatgtagtttcttaggagctgagtatgattacaactctcttggtgaggctgtagaaaaactagtactttcagctgtgctgttcagagtgtaaaatgataaaaccccagagggttatgtagcaatatttatctaaattaaaactctgtaggtacccttatatctaccttttgactccgcagttctgttcctagtgatttgctcaagagaaatgaaccatattagagttctttactacacagagcctgttcatttatgtattatctgtggctacttttgttccaaaacagtggagctgaacaactgggagagagattatatggcctgcaaagcctaactgacattttactaaaaaccttgcagacccctggtatagatgagctggcatactcaggctggttatccattgtgcctgccgggaatggcacataacaaattaactaactaactttagtaggaacaccaatcataagcaaatggacctagattttctgaataataaaatatatctttatctgaagataaagatatacccacaaacagacttagaccagaatgcttatagcaactttattcataatagcgaaaagctagaaacagcccaagaatttatcaacagaatggataaaccaactgtggtatagttataaaatagaatgccctgagtgataggaaaggaatgtaccactaaggcacacaacatggatgaatctcacaaacatgctgagtggaaaaaaaacagatgcaaaagagtacatacctatgattccatttatatgaacttctaagagagaccaaactattctatggtaggaaaaaccagaaaactggttcccattggggatgaggaggtagaaattaactgggaagaagtatgaggaaactttctggggtgatggtaaaattttctatcatgatagaagtttaggttacacaaatgtgtaagcacttgtcaaaattcatggaacatacacttgaaatgtgtgttctactgtatgcaaattttacttttttaaaaagaactgtatggatgtttaaatgtttagaggtaaagtgtacttatgtctgtaatttattttgaaatgcatccaaaaaataagatggactgatggatagagggatgaataaatagatatatgataaaacaaatagagcaaatgttaattgtagaatatagatggtaatatataggtgttcactatgctcactcagacttttccatgtatttggaaatgatattgtgggggaatgtacataccctttgatccaacagttctggaaatttatcctacagatatcctacatggatgtacaaagacatatatttaagtccactttattacagtattgtttgttacagaagagttgaagtaacttaaatgcccatcagtaaggcgtaatgaaataaattatagtttattcagagagttttacatcctgtagtcatttataaaaaaatgaaataactctctatatgtgctaatgtggaacagtccccaagatataagtcatacaccacacacacacacacgtgggggaatacgtatatgaatgtattctaccatttcaatgaggaatacatataggaataccaaaggaatgcatatatgaatatattatgctaccatatcttgttttaaaaaaggacatatacacacaacatgcacaaagacaagcatacttatatatacatatataaataaatacatatctgtttgcatagaatttttctcaaaggctacccaagaaatggatattagtgattgcttctttagggaaaattgaggggggtggggcaataggacaaggttagagggagactttttattttttgccttatatagccatctgaattttgtactgtgtgcatgatttacatattcagaaaataaatataagctaataagagaccaatgactttgaaaagaagattgagaaagaaaagccaaagaggcaggaggaaaactaggagagtatattatcaccaaagccacgggaagagagtgagttttcagtcctgtctagcattgcaaagagctcagtaaaatggagattttttttttttgagatggagtcttgctgtgtcgcccaggctggagtgcagtggcgtgatctcggctcactgcaagctccgcctcccaggtttgcaccattcccctgcctcagcctcccaagtagctgggaccacaggcgcccgccaccatgcccggctaatttttttttatttttagtagagacggggtttcactgtgttagccaggatggtcttgatctcctaacctcgtgatccacctgcctcagcctcccaaagtgctgagattacaggtgtgagccaccacgcctggccaaaatggagattttaaatgccaagtttgattcagaaatagagaggtcattaatgaccaaagcactaaccttggttccaccctgcctaattttcagcgcctagaagattatcagcgtcgccttgatacctccagcctgaagttgtcagagtacccaaatgttgaagagctcagggtgagagatggtctaatcataatttaaaaaataaaataaaatttgctaaagacctggcaggtaattaacatctcagtgggaatatacgtcacctgaaggagttcttgtatcgtagattatctgtatttatgattttttttgctgccttttaaatgcttgatctgtatgaaattagtttttcattagaggaatatcttgcataaaactgtaatattacatgacagcaattggcaggagactaagggacactaattattataaaatttaattttattgtgttctgtagtttgtttcagacagggtcttgctctgttgcccaggctggaatgcagtggtgcagtcttggctcactgaagccttggcctcctggactcaggcagtccacccacctcagcctccctagcagctaggactataggtatatgccaccatacccagctaattctgtgttttgtaaagacaaggtctcgctgtgttgtcaggttggtccagatttcctgggctcaagtgctcctttctcagcctcccacagtgcagggattacaggcatgagccactatgcccagcctgtgttctgtagtttaaataagggtaggactgtttggtaactttccagatcatttaataacacaagatagcatactattttctcatgaggctcttcagaagcataaaagttggaaccattacaggaacgatagtaaaatgtttactaattgccacttctagtatgtgggcttatgtgttaactttttcggattttaagtgtttttgtaccatttcactaggtggtggttttggcagatttatttggtggctgttaaaatagacttttatgtcatatattaatacttcgtcaacaagcacgtaaatgtgcttattccccttagcttccaaagaatgagagttttctagagctgctaatactaaaagatgattctcttactaataagttgttaatatttagaccaagtctgagtagtacctggacttttcatgagtactatttcttagaactttctttgaaattagagccttggaactcagaagccactttcttatagacaagcatatgtaccatgctcatccagttattcataggaaaattaaaggatacgttgagaatctagtgactgaatgtttgtaacttgatcttcataatctgttatcatctgtttagagtgaggtttgaagatagtactcctgaatgttcttctgcaagataccttttcctttttagaaaattgtatgcagattactttaatatggcttttgtgccattttcaagaactgacaaatagcaataatgatagttgaatgtaaatggtgtattttatattaagaatttctttaaaagagactgtattatatagataatcatgttactgagtgcttggaaattatttgtgcatgattttctttattttgccagaatttggatttaacaaaaaggaagatgattcatgaagggccattggtttggaaggtgaatagagataaaactattggtaggtctgatattgtcttttagttttggggagagtggcaaaagggaaggaataggaaagtttcctatgacaaagggaagaggagagaaccattctctcagcagtttgcagtgctacctcgtgttatttgtacatttgtagatctgcttgtgttatttcattatatgtaagatgtgttaaatattcatttaggaatgtagtggagaactgatttagtcctatttccatcattcttatagtctagtgagtctttgtatgctttgtaagctttctttagaccagtacatcttaaactgtctgtgatgaggaaccgtttttgttttttcagaaacaaggtctttctatgttgcccaggctggagcacagtggctagtcacagatgcagtcatggtgcactgctgcctcgaactcctgggcttaagggatcctcctgccttagcctccctagtagccgggactataggcgcacagcaccacacccagcttgttgttttttatttcctattggtcacagactgacacttcagtgaaataaaataaaaatgaattactgaaaatgaaattttaaaagataatatacaagtcaatttttaaaattttgtagctttaacagaaatagaattcctctgttgaatcattataaagttaatcaaacgcgtctccatttctgtacttaccatttttttctgcacttttatttctagatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacaggcaagtatgtccactgaaggatactaatttccagattcattgtgaagttgcataagatactcggtgctgtctcaataacacaagtggcatagagtcttgctatttttatattcttaagcaaattacatgaaatttactgcttagaaagagacctaagagtttataccccaaagttattagggtgtctcgattctgtgaacagttttctgcatttgaaaatttttatgctattactttggttctttatgttcaaatcattgatagatcccaatgaaaagcctttcatttagggtggtatgttttttgatttggtgagaaaaaaatcaaaaaccaaagagacggatgtagtgttgattaaaaatcaaatttgactggcaagttatattttaactctattaacaacggggtcccttttaaaacttgttagtttcatggtggcaaaataaatttgtgacctcttttctccactactcactgaatattattaactaacaacttagcaaaagtgcagttcaaaataaatgcaaaagagtaatagcatttaatctggtaatttggatttatttattttttttcttttgagacgagggtcccaccctgtcacccaggctggagtgcagtggtacaaccttggcacactgcaacctccacatcccaggctcaagcaattcttcaacctcagcctcctgagtagctgggactacaggcatgcaccaccatgacctggctaatttttttgttttatgtagaggcagggtttcgccatgctgcccaggctggtctcgaactcctgagctccaagcggtccacctgcctcggcctcctaaagtactgggattacaggtgtgagccaccgtgcccggccagtaatttggatttttgacatgcttttagcaaagtttctagtaaattattgtggaattagtgctaattcgtataatctttgttttattgaagtacaataaatatagtacaataaatacgttaatatggtaagttgcacaaattttaagtgtacatcttgatgaattttaaagtaaatatatgtaacctttatctagtttaaggggcagactatttcaagaccctaaaaacatccctcatggcctccccaggtcatagtattagagtaatcttgtattgttttttccagataacaaagctttattcgtcatttccatgtcagacaatggcgctcagatttatgaactggtggcacagacagtttctgaaaagactgtgtatgtatcagatatggctaccttgctatagctaatattttcattatcccaagcgtaatattccataaacttaactttgtttttataatgtatggaaaccaagcacttcctctgtactcttttagagacgttctactatgaacttgttcttttttaggttgatgccttttattttgattctattctgaaagtttatttcctaaagaaaaaattgtgcaaaatgtcaagtgaagtttttttaatgtgtccatagatttctcttaaggtatagttttggactctcgccttaatagtgtgttgccaaaataaagatattctctggcagagtgggttttgttgttgttgttgttgttgttgttgttgttgttgttggttgatttggtttttgtttagttttgctttctgagtatatttaaaggatatttcttttttcttttttgtattttggatttctttccaactttctgaagctggcaggacctaatctgtcggatggctgcatcagtgaaggagcaatccacaaagccaattccattaccacagtcaacacctggcgagtgagtgttcctttgcattgtagtaggacttattttatgttttgggttggaaaagactaggataattattatgttttgttgcgatgatgtttagatacctcaggaaggtaaaagtttttttttttttttttttctctacagaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagataggcgtatcacctgaggccaggagttagaggccaacctgaccaacatgacaaaaccctgtctctactaaaaaatacaaaaattagccgggcatggtggtaggtgcctgtaatcccagctacttgggaggctgaggcagggagaattgcttgaacccaggaggcggaggttacggtgagccgagatcgtgccattgcactccagcctgggcaacaagaccgaaacaccaaaaaaaaaaaagaaaaaaagaaaaaaaagaaaataaaataaaatgcaaagaaactttaatactgtttggtttatgcaggttccagcatcagagattcagtttaacaaactttgcctttgagccttctgtgtgtcagtataacactgttctaagtgatgtgtatttttcttaacagatgatctctgtagtttatggattgttttttttttttctgattcttccctgaatgcttcatgttaaaagttaaaagctttgtttagatatagtctaccttttctattccattggacagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaattgtaagttttattcataacttattacagatacttactaagtatgacactcatgtgccatccctaaagtatgtggatttatcaaactccacttattcttctagttctattgtggagattatagtattctctacagtggcccatgccacaggcacacacacacatgccactctgttagctccccacccccctgcctggttcagaatcactgttaaaatgggaggatagcatatctctcagttgtattgaggtgggaaaaaggctgagaacaatttctttggctggggagaaccacttgaaatttttaaaccagcgtatgactaaaggtatgaaaaaagattaatctggctgaaagcggtggaaggatttgaatggaaagaggtatggaatggtgtacttactaaataagctattataatagtctggcctgagactaaaagagtttggactagaatgttatcagaaggaataagaagaaactgagaagtcatcaaatgcttaaaataattgacttctttgaatgtgaggtcaaaggaaagggaatatttagagataatttcattaatctagtcagaaataagagtcagaaaaggactaccactgcttcccccacctccttccattgtactttcttttttctttcttttgatttggtagaattataggctcagttttaaagcatgtcaagattaagataatgaatgacaaaacactaaaaagtgagtaactagcaggaagttagagttttaggagtgaaactttagagagaggttaggaagagatagagatgtgagcatcagagccatgagacttcctggcatctctcaggaagtgattgtagagcagaaggacagaggatgagagacctaagtggaacctgttgcctaaagaaacatgacagacattaagctagtgatgagagcagagaattggttatttaaaacctacaatattttttataccttctcctgaattaacagtcttaataatttctgatggttggaataacattgtcccaataactctatcattgtctgggtgacctcatagcatacacttggcccattcaaaattaaattggttcttattttcagtaaatgtatgtatctcataaaattagaggaaataatatgcatatagtgtctggatctggaaaaagcagaacttttttttagctttttctgtctagcttaacacagcctttcaacattcttaagaagtacctttagggtattattctagttatatagaagaaaaaatagaggcatgatattggttattgaggagttctaaatagtagtatctccctattcagaatgcttagatcttttcaagtttagtttaacgttaaatcttctctaaaagatggtgctttatttcatcttcaaaacaaaatggaaaatgattgtatgaagtaagatgattgtatgaaattaataattaacattttaatatgtcattaaaagatactttttaaagatagatcattggtaagtcagctaatttaattcttgcagcctgaggttatagttgtgaatatgttttttttccccctccttcctaaatcgtttagtgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggcaagtatctttcacacttaaactttgattttgattttgatcattgttaactgtcctgtattttgaaatggatgttgtattggtatccaggtgtgtgtgtgtgtgtgtgttcacacatgtgcaatatttattccttcatttgataaatactgaatctactctgtaccagacctcatcataggtgctgggagatatagcagtgaataaaacacagaaaaatcccatcttctcatgaagctaggggaaagaaggatggtaaataagtaaacaaataaatagacttcaggaagtattaggaagaaacataagtcagactgaggggacggagagtaatgaaggcaaacagggtgatcagggattaggacctccgatgaggtagcatttgagcagagacctcaatgaaatgagggaataaagccgggtgggtacctgggagcttactattccagcagagagcagagtggggcagaggctttgtgtcaaagagcaagctttttgtggtgatcgaacactggatgagggagacaatggcaggagatggggcaagagaggcgtttggcaggggaagtggtagcaagatcatttaggcactgtagtttccagctttaaacttttgaaatgaaattttttggaaattaccatgaaagtttgcagagtttagctttcatctgaagtgaggaaattctgatgtacctgaaactaaactcaggaattaatggcttttccctctcttaataacttttcaagttgaagttgtcagcacactatgctatttctgttttctaatggcagcactggtcttatcaaactattctgtctctatccataggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaaggtacctcatacttccacatccataggacttggttgtaagaaacatttagcagaggggaagaatagggtgatgaaaatgctgatgtcaataaacttgttcaggttctagatttctttgactattatccatgaataggcctgggtaaaaagttgagattggcattgtttatctttttctttctttctttttttttttttttttgagacggagtctcgctctgtcaaccaggctagagtgcagtggcgtgatctcagctcactgcaagctctgccttccaggttcacaccattctcctgcctcagcctcccaagcagctgggactacaggcacccgcccccacgcccagctaattttttgtatttttaatagagacggggtttcaccatgttagccaggatggtctcgatctcctgacctcgtgatccgcctgcctcggcctcccaaagtactgggattacaggcgtgagccaccgcgcccagtcggcattgtttatcttttgactatcacaagagcagaaaaagttgcagctctgtgaactgtgtgtttgtatgggtgtctaagtttaagaacctgaaatgcttcgggtagttggctggcctctgtcagacatgaacaagaagatgagataggtagggtttatgtagttatgaatctaggctgagaaatgctatgactttctgtagcctattatctgtgactcattaggtgacattggcagcttcccaaatcctatgacagatagaaattggcttcagtggctcctgtaatctaaaaacatggtcatgcatgggatttttgtagattggtaattgaagatgtcactattgcaaaactgacttgtgtggcaatttccaagagaaagacctatcttaaagttttccatcagaggcagggcacggtggctcacgcctgtaattccagcactttgggaggcaaggcaggcggatcacgaggtcaggagatcgagaccatccttgctaacacggtgaaaccccgtctctactaaaaataaaaaaaatcagccaggtgtggtggtgggcgcctgtagtcccagctactcaggaggctgaggcaggagaatggcatgaacctgggaggcggagcttgcagggagctgagatcacgccactgcactccaacctgggtgacagagcgagactctgtctcaaaaaaaaaaaaaaaagtttgccatcagaaaacacagcttccagagcccaaacattttcctcatgacatcatttacaccagagacttgaggggtagatttaagtatccttagcctttgagttaaagactggtctcccttagtttctcttttaccttcatataattgatttttccctcttcatgttacttattttatgtagtatcattctgtagctgatgagatatcgacaagcccattgaggacaggtcggttcttatatacagtcatgtgttgcttagcaatggggatatattctgagaaattcatcattaggcatttttatctttgtgtgaacttcacagagtgtacttacacaaacctagatagaatatatctttatttacatagattttttcatatggaaagccaaatctctcaacactattactgaatattagtcatttcccctacctgatcagcaatgccattattaagtgccacacaccaggtttctacatgtgctccataataatcttttttttttttttttttttttgagacagtcttgctctgtcacccaggctggagtgcagtggcgctatttcggctcactgcaacctctgcctcccaggttcaagcgattctcctgccttggcctcccaaggagctgggactacaggcaccaccaccatgcccagataaatttttttttttttttaaatggagtctcggtctgtcacccaggctggagtgcaatggtgcaatctcggctcaccgcaacctccgcctcccgggttcaagcgattctcctgcctcagcttcctgagtagctgggattacaggtgcccgccaccacacccagctaatttttttctatcttttaatttatttatgtatttatattttttgagacagagtcttgctctgtcgcccaggctggagtgcagtggcatgatctctcctcactgcaagctccacctcccaggttcacgccattctcctgcctcagcctccccagtagctgggactacaggcgcctgccaccatgcccggctaattttttttatttttagtagagacggggtttcaccatgttagcctggatggtctcgatctcctgacctcgtgatccgcctgcctcggcctcccaaagtgttgggattacaggcgtgagccaccgcgcccagtcccagctaatttttataattttagtagagacaggatttcaccatgttggccaggctggtctggaactcctgacctcaggtgatccacctgcctcggcctcccaaagtgctgggattacaggcgtgagccaccatgccccacccataataatcttaagggaccatcatcatgtatgcaggccgccatgtctttatgtgctgcatgactatagctcatgcacatgatgacgggaccatgtccagggtgactcctgggggtgggagaattgcatctatggttaccacctctactttctttttacatgggaaaatactaagttattccttcagtggagaaattggtaaaaggaatgaaatttacttttttcttcccactaatgaaatttttaatgatgaagttaatatttttgaaatttgggggcttgtacctgtaatgtaaaaagggcttcttttctgttttctgaagtttttgttttgttttgtttcattacgtttgaataaaaaacctatgggttttatttcacagaaggtggaggaaagttacaccattctttgccaaaggctggctggatcagccctcacagacaagcactcaggtatgtaaaagttatgagttccagactctagactaatcatcctacactgaatgaaatgacttatcatactttgaagtgaaaaccttctgagattccatttctcttctgtctttaaagaactgcctgtttctaaacatcagatatcaagcggaagctcatgcctgctgactctactcttctctaagaggaactgcagttgtcagttcccataccatcccctcttctctctcttttcaccttttcaaagcagaaggcagagcagtgggaagcctggtaaatcacagattcggtgtgaggcttactggtactgctgtgactccctagtgtggaggatttggccttattggatgttggtgcacttgcctctgctgacagtgtggctggtgtctcccctgactgcagatggatttgtgttccctgcagcagtttatactcatctgcttacatactgattcagaaacaaagattgaaccacgcccacagatgtcatgggtattctttgcaatgttagtatattctttttcttaatatcatttccatgtatctttattcttctcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 7 - DNA, 153525 bp, Homo sapiens
  source 1..153525: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggttggtatgaattcctccttcgttcggcctcccggaatcgggcccgacctagcaggggagtcggtgattgcagattgcctttggccagcgaagttgacaggcagaggaaagagggttgtttcggagctgtgcagttagcctggggttgctgccgagttatccagttgattggcttttggaaatgtaatttttccggagagaaacttcccttccgattctcagagaagggggaggcaaaaccatgattgtggttttccgcctgtagtgtgcattaggattgtgtactcgtctggaaatcagaggagaaggtcattttaggtgaaggtcggtgcctgaagtcggctcggtattggtgtattatttatcagctttagccgtgtcctgcagtagattctcaagacaattacattttaggaatttctacctgtgaacttaatgttgagcctactgcatggtgatctgggaacttgatctctttcagatgttgacctgcacggtgtttaattattatctaataactttccagaatgttgacattaccagtaaatcacaggttcttgctggaagcaatgtccaggagctgaagaaatgagggtaaatcatggggtttgcttttaattcttgtatttaaatatttcgtcttccagaaacacttggcgtttaagagatataagccgtaagcatagtgtaagcgcgcagctgaatttgttgagttctgtgtctgtcctttatagcacctaccagtgttgcatggtggtgggtggcgaattgagctagaccatgtgtggttgaagtgcagtttgcttatcctaagttactcttgtttatagggtaagggataaaaagcatattgattccttgaccacatttcattctcaatttaattatgacactgcatgctagtcccaaatttgtcagcttgctttatttttaagtcagtcttcgaattattacaccgtgaaaaaatagatcaagtaactgaattagagggccaaagctctttgatgaaaagtgcaacaatagtgcttctgcacaaagtagtcttaatttcctaataagagttttacccaattgtaagactcatttgttgattttaaaagggccaaattccattatcataccataacagctactccagaaacagaacttcctcttcctgttgatgctttccagcatcacatgaatgttcacttaaaagagtctgttaaatatttaaagtatttatatttactctttgtgtatttttcaaagtgggttttcattttcaatgaaataatttttaacttttccaagaatacacttaagataagtattgacaatgcttatcttactttcttctggttatccccatttttttcctttcagggtgttttgcttctgagaaatcacttttacgggtgtggggataattgttttcctgcttcattcaattctcgctctttctgttgagcctgtaaacaaaagtcttgctaggaactaatgtaatgttggttttcattgcgatgctgaggtgtttaatttatggaaacagaacggactcattccacacacaagtgagtgaaaagccctcaagtaatggtttttcttcagcattgcttctcagggattttccttgtcttctcgttatcttggaaatagaatcttggaatttgtatcctctttataacgtagatggcatataaacattcaataaatatgaaattactgaaagcctgtttcttttctttttcttttttttttttttttttggccaggcactgtgcaggcacaagagattacaaaatgaatattgtaagattaatctgcaaattggtttgggcattaatgttttttgaactggttcaggtgctgctgcctaattttacattttttttttttaaagaaaagaccttggaaagccaattaataagcactgctgagacctgtttcgtaggatttttttttactagggtctttttttattaagaattattcttatttgaccacatttaaatatattttgtaaatataaagcatccatttgctgttaagagagtagttgttcctaatatgaatatatgttggggtgaaatctggaggtactggtttagtattatttctctgccaaggtgtcttaacaaagttacgagtatataatagtttctagctttctgtcagccctacctcatccttttttcgtagtgtctaactcttactgtaggtatattttgctgactctagaactgttggaaaattaacagcaccagtgtagctttttagatagagatcctttcaagtttgaagtgctgtatgtggtatggctttgtttcgtagagtgtgcagaaccaccaggccagctgtgtgagttagagttctttcattgtggtgcttctgactacagagtctgtctgtcctcagttgaaatcagactagctggttttgggcgttgttctgttttgcagtttgtggcaggcgacacatggctgaacaagataagggttttattcttgtgttagggacgtgctggggctgggatggaattcagctatgtttaggctctgattggtcactttggatactcagaactctgttacatcctgttattattttgcagttaaatcaacacattaacttgctctcttctctttcccttcatcttttactccccagtccgcaccccttaaaacctaaaactcaaactttttaaaagactttaaactcaaactatgttcatggtagctattacttctatgtagtatatccaaacagctttaaaaaaaatggtaagcaatttatgagccctggagtctgtagttttcatcgtttagaatgagcacttgacaagtgtagaaatgtctgattgctgctttttagtctgcattgattgctgcattcagtcttaaaatacatcctaatcgtttccaatcctcctacatgtctttcttgtatccctgagaatttaggggtcctatagcaattggaatttcttctgagaggtagacaggagagaatgcccttttagtagactcagtaaatgatttcaggccagtgtctataacattgaattttcagggacagtacaggtaggaaagttatagggttcttccttgaaataaatggacttttgttttggctagggcttatgaattttgtagtttttgatttatagataaagacaggtttttgatacaatttttttaaagcactgaattcagctttgagctgtttaacttaagcagatttttaaagtgagtgtggaaacctgtgactttatatgcctgtacccagtaattaatgatacttttcattagtgatactttttctgtcaaaattgctgtataatggttttgattaaaaaaaaaagagctactcatgtttatatgttattttcaacgttgcatgagtcatctctcggcaaggtgaaattatttgtaaccttttcttgtaaagtcagccagtccataaatacaaaattgaaatgggggccaaagatcacagtgttagttttgtattcagttttatctttgcctttttagttcagtataaaatcttgagtcataaaggtatgcaatagtacattcacttgtacagttttacatgagtcaacatgcagaatctaaagtaactttttttgaaagtacagtgttgtagtcttcctgattaatggtacatttatatgatgttcatattcagtaaggtgacaagagaagctttatttgaaatcattacaaaaatatgttaaccttggaataccacttaacacattggtggtttccggttgttaacatgtatataccatcgagttaacatgtaggtttttttcttttttgagtcttgctctgtcacccacggtggagtgcagtggcgtgatcccctcactgcaacctccgcctcccaggttcaagcggttctcctgcctcagcctcctgagtagctgggattacaggcacccaccaccacgcctggctaatttttgtatttttagtagagacggggtttcaccatattggccaggctggtcttgaactcctgaccttaggtgatccacccgtctcggcctcccaaagtgccgggattacaggcttgagccaccgagcccagtggttttttttgttgttgctgttgttgttttttaactaagtttgagttttcagtttaaaaaatgaaatttgaggcaaacattcatggaatccataaatggtgaattttacatatgtttctgtggagcattgcgattccagggaaaacagttggaaaatatttcattgtacatatgtggttgcctcttctaaatgtcatccagtggtgggtatgaattgcttcccaaactgatacgggtcacagaaacagcaagataacatactggttcccagaggtaattgaagggactcttttgcatcatggttgtctgacattattagaaatgtttcttatatacttgcttgtttcctagaaattgaccatgacacattttcaagaatagtagcttaacttcttttggtcttttctgttaaaacttggttttgatgatgttcctgagctttatttgaagacatgctcctttcccttataataattacaggttttcaaaatagtgccatgtgagttaaaatttttaaatcaacaaaattatatttttgccttcttttgagtaaaataccatcatgtaggtaatgatatcctgtggtagtataattctttaacatttacaatattttcagttcagtacagggcagatcatgcttctgtcatttacactttaagctaattcatacagtttaagtcaagattttaagtcaagattataaaactagaaagggcagacccaagattttaacctagattttctggctctcaagtcccccattgttttttttcattttaaattattgtctttctttgtactgtatttttctgtgctattttcctttagtaactctccagcttgatgaagtcagttggatttttctcttacagcatagtttctagtaccttacccattctaattttaaatatctcttgaggataaagcttttgtcacttcctcaggagactgaagcacagtctgatagatcttgctgtcaggaagtttttcctgatctttacgtctaacttttcttttaagttgtcctgttacttgtatgtacttgctgtaccaggctaaataatgctctcctcccattttatgtttgtatgattctaaatgtttcagacggttattcattatcctttccggtccccttcccttactctttgcttagccaagctgtatgctttctgttgatccattgtctaaaaatcagcttatcttaatatttcattagctttttctcagttgctctcctactgcaaaaatatgggtaaagagattctcaaggtcattttgattcacttttattttagatagtctttaggatggatatgagatatgtcacagtcaaatgaaacaaatttatacaaacagcatgattaccaaatcaactaattaagcaattactcatgttctaaaaggcttttttacaaagcgattctttcaaatatgagtaccctcaatgtaacaaatgttatcaattctatgacaaaagggtagggtatagaaataatgttagccacctttgatggaaaatcatcttgttgcaatatgatgaaatacatcaggaagttgtttcttattttttccagtggtttttcagttcgttatcttaaattgtaggtcaaaacattcctcgatgtttggtttatttttaccttattgttttgtctcctcttatttccacatgttagtgaaataacaatgcttagcagtattttttttttcagtaaaatggatattgtgaaaattgaaatattttactttcttgctgttgtatttacaagaattgttaatgacaagacagtgtaacagaaaaagtgcatatttagattattataaaatctgtaagactgtagaccttttgaatactttattagcatattttctttagtactattttagtttcaaattattgagatagatgtccttgttttgtattttgctaatattaatattttgtattttggtaatactaaaatttgcaaacatgccaaatttagagcattttactttttcaacttagaatatctggaatcatcaagatagtcatatagggaagaccgctataagacagcttctaactccaatagaagcctatgaagctagtgcctggtcagaggctgtgcctaaattgcatgagtatatagtgtcgacttttagtaaaagaaaaaatacactaactttacctcttgaattagcatgcaccaatgcagtttagattcataccgaaacaggatcttttactaattcaaatgctgagtcctggtttttgagatcacagtcacatgacaggcctgggtggcttctcagtgtctagagacaagcaaatctactggccaatgaaaagtaggtttcctgtcttggactgcaagtaacaattcatgcagaaattggaactatataagagagcctggttttagttaatgctttcaattagctgcttgtcacactgctttttcttttggtgttatataacacattagagtcatttaaaggtacactctgatactacagtttttgtcaaatattacatataaatgttgattttacattcatatactcaaaagatcaaagaggactttgtagatcttttatggattcaaaaaaatgtagattattttgttgtagaaaaactggccaggcgcggtggctcatgcctgtaaatcccagcactttggaaggctgaggtgggcggatcacttgaggtcaagagttcaagactagcctggtcagcatggtgaaaccctgtctctattaaaaatacaaaaatgagccggaccaggtggcacatgcctgtaatcccagctactcgggaggctaagacaggagaatcacttgaacccgggaggcggaggttgcagttagccaagattgcaccactgcactcctacctggatgacagagcaagactccgtctcaaaaaaaaaaaaaaaaaaaaaaaaaaaaactggagacttcatcagcctctgaaggaatgatacctgaaattgatcttgtaatgcagaaagtggctatatgttatccagaagagtaacagataccccaaatacacttgctaacacaagaaatcctgtgaaggtgcttagacatacccttccatagattttagatgggttatctgcctatgttccagacacaagccgatatgttgtggtttgcccagtacagtctctgtggtttactgagaggaagtggttcttgtgggtgaaggtctgatcttttcagagattgttggtggcatatgcactgtcagcctatttcctgttttattggctgtttagcaagaccttcttagggcaagtgctgctgaagaggtatttaaatattttgtattggcaggatagatggttataatgatgtattattatatcactacttctcaggtgatatgagagttaaatgaatgtttgtgaagtgctttgagatcttaggatgaaaagtacagacatgttcttagtcatttgcaggttactgctatgttcagatattgctctcttgaagttaaaacttgttcatgtagtaaagtgttactctattaaacttgatttctgtaaccattcaagtgttgttttatcaccacaagagtcatgattagaatttttcccctttttttcctttctttcaatgctcctttatgattttaccctagaagagtttccttaatagattccttgctctagtactggttaaggcatatttaccaaacttaacacctagcaagcttgtccaacctgccttattttgctgttgttcttctgttttgttttgttttaggctttcagcagcctgaagccatggtttttagtttctgtctctagtgataaaacggaaagagggatgaggaaggggctttactggcccatccagaaacagaaactaagaacccatgactgtattctctcccttgaacaactgtaactagagcaaacctctttgccaatttaactggcatactaaaataatgaaattgtgagaatttcctttgagattagtaactgtaccatccatatacaaaacactatattgctttgctgaaacctgaaagtgagcaaactgatagaaatgcatataacaggccgggcgtagtggctcacgcctgtaatcccagcactttgggagaccgaggtgggcggttcaggaggtcaggagatcaagaccattctggctaacacggtgaaaccccgtctctgctaaaaatagaaaaaattagccgagtgtggtggcgggtgcctgtagtcccagctgctggggaggctgaggcaggagaatggcatgaacccaggaggtggagcttgcagtgagccgagatcgcgccactgcactccagcctgggcacagagcgagactccgtctcaaaaaaaaaaaaaaaaaaaacgaaatggcgtatgtcatactcctaaatatatatatatatacagtatttagccttggacgttaaaaaaattaacaatgaatgggggaaggctttatttaaagctaaattgttagctaatacgtgagttcttcaagggtataagaatagttcttattcatttttaagtaattatcggtagccttattatatttttattttttaatactgaaaagcagaaggaagaaaaataaatggcccaaatgatccaactacccagatgttgctgctcaggttaaacgcacacacgcatacacacacagaaaattcaaatcatataaaatggtataaaaaaaagtattcctacacacctgttagttttcataccttctcctcataggtaacaatagttaatttttttggtttatcttctgaaacatttaaaaatatataccagcctataattttattttttgcacctactccataataagtgtatctgtcttcttttgctaggttatgctgctgtagcaacactatcaaatttcagtggcttacaacactgcttttcttcttgcttatgctacaccttgtcagctgtggattgactgcagcattgcttcacgtttcttattttggaaccctggctcaaggagcatcccctgtctgggctgtgccattattgtggatgagggagagagcaagaaaacagatgcagacatacaatggctcttaaagctttcactcagtcatgttgtatgtcacatcagctcacatgtcagtggccaaagcaagtcatatggtcagagctcactgtcagtggggtaaggatgtatagtccttccacaggtggcattgcaagttgcatgataacagataaggctgtataatcctcttaaggaaagtggaggttaaataatttggaacaataaataatatagtctacatcaacaagttcagtaaatgcttgttaaatgggttatttggagtctatgaaagtttctttttttttagtgggaaattcaaacataaacagaagtacagagaatggtatgatgaacctcccttgttccctttattactccagcagttaatgtacggacaatcttggtttatctgttttctttccccccttctcactagattattttgaagcagtttttggatatcataatttcacttacaagtatttcactaagtatttttaagagataaagtctgaacgtgtgacttctcatagtaaattattactgtctgatagggtgaggtaatagtactatatagactgacaggtgtcaagcagcagagcacgttcatagagcgtatctagaatttgacagcctgaacttgttttgatttcattttgagtatttctggaggaggcttacaacagaatgccatctacttttccagcctctccctttctttctttctttccttccttccttccttccttccttccttccttccttccttccttccttcctttctttctttctttctttctctttctttttctttctttctttctctctgtctctctctgtttctctctctctctctctctctgtctgtgtgtgtgtgtgtgtgtgtgtgtgtgtgtgtgtgtagcagaagcaggtaattaacctctggaaaaaataacattgcaacagatttgatttgcagaggtttcatttctcactgagcctctgttggaatgatgccagttgaaaggaatcccagctcttaatggctccaagtcttctgggagctctcagtgatgttattttctttggagaagaacatcagaatcatttataaaaatcctgtgttcacccatgccatttgctctgtggagaaaggatctatcatatctttaagatgatctctaagatgatataaaagtaaagaaattcatctatctaattttagtttagaaatcattaatgccaatttcagctgctcaggttagtttgtcttgaaggcctgaaagcctccattttgattcaagatgtcgtagattttatgagcattcagtataaccagtaagtttgtcatttccatggttgtagggaatatgagacattctgttatggatctaggattaccgtttcacaggacattctttttttggggggattgttaggtaataaacagtgggacacaaaataaacagatataatctcttcagtttgtagattttcaggtgacaatgaggtggcagaagaggatttgtgcagattaggaaataaataattattgtatataacatgatggaaatattttagtatagtaccactatcaaattaattttgtttccttaactagcttctttcattgtgtacagagacacttatattaaagtagtctttatagatatccagttagctttagttttttctaattacattatattgctagtctcatttcagagtccatgtaggaactacagtagaaaagtagctatcattggcttgtaaataaaattacttaattttgagtttttcttgggaaggaaaaaccagttttacagaattagtggagttgattctggttttggttacttgtgacaatatagtctatttaaaatataaataaataaaaatttgcccaagaagaataagtttgacttgccatgattcatactgtttttctgttgttgtatcacaattgagaacattagtttcagaggtaatagtttgtcagtatgggtcgagtagctctaatccaaaaatccaaaatcagaaatgcttcaaaatctgaaactttttgggtgccatgtgccacaggtggaaaattctacacgtaagtacataatacaaactttgtttcatgcacaaaattatttacagtagtgtataaaattaccgttaggcgggggccaggcatggtggctcaagcctgtaatcccagcactttgggaagtcgaggcaggcggatcacctgaggttgggagtttgagaccagcctgaacaacatggagaaaccccatctctactaaaaatacaaaattagctgggcatggtggcacatgcctgtaattccagctactcgggaggctgaggcaggagaatcgcttgaaccagggaggtggaggttcaagcgagccaagatcatgccactgcactccagcctggaaaacaagagcaaaacaccgtctcaaaaaaaataataataaaaaattaccttcaggctgtgcatatagagtgtacgtgaaacattaatgaattctgtgtttagacttgggtcccattcccaagatatcttactatgtatatgtaaatgttccaaaacacaaaaaaattcaaaatgaaacacttctggccccaagcattttgggtaagggatacccaatgtgtacctttgttaggataatatacttgtaccttggttgtattttagttgcaattgttagttgcacaatttgggggaatgtttgaggtctctatagtagttactgtatttaccaggaagccctgcatgattagaattcttgagacagtgtataaagttaaattgggtgtgttgcctggatgtgaacagtaaaaaaggagaagcttctcaccatacaattatagcttaaaaggaaccaggtacaattctgtttccaaaaatagaaagtaagtcaaatattatatggatatgtaatagtaattatattaattttgactccctggccgactttttttttgaagctatcattttttgtcagagataaaaagtagcttttaaaggaaaagatatctcagcccttaattatgtgtgtgtgtatgtgtgtgtatgtatttatttatatattttagcccttgtaagagaggagcagtggaagggaactgaaggagcatgatatagagaaaagagcctgggttttggtgtgttgcatttgttctgttactagctgggagaccttgggcaaatttacctctctgatcagcagtttaattttttcatctgtaaaaatgggaagaatacctactttgcagaattgtcgtgacgattaaatgagagtgtgtgtgagtacctagcacatcgtaagagagagctcagtaagttatagtagctgttattgtttaaacttcaggaattagctaggttttgctagaactttcatctgtgcttgtaagatctttttgaatccatatgtatttttagcagctgtggctaagatagtttttttcccttgctgtgataatattccttatcttttatatttcaggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagttctgtatttattaacatcagtttgtttatttattcagtaaatattgaatgcctgttctgtgtaggtcattgtcttggcagttattttgagctcttgctacctgctgaattatatcttaaaatgaagaaatttacatgatagagtgatatttattcatctgtgctgaagattaaagtgagaagtatgtggcaggcgcggtggctcacgcttgtaatcccagcactttgggaggccgaggtgggcggatcatgaggtcaggagatcgagaccatcctggctaacacggtgaaaccccatttctactaaaaatacgaaaaattagccgagtatggtggtgggcacctgtagtcccagctgctggggaggctgaggcaggagaatggcttgaacctgggaggcagtgcttgcagtgagctgagatcacgccactgcactccagcctgggtgacagagcaagactccgtctcaaaaaaaaaaaaaaagtgagaagtatgtgtatttgggggaagttgtagaatgaaataataatgattaaattgatcttatttccaaattttaaaaatgtggttactttctatcacatactgtctttttatgttttcctttttattttatttttcagtttagttatatttcagtgaactatttagaccaaaatggaaaagacattggtgtaagttggaatctaagaagttttagatgttcattgcttttgaacagaggaagtaacattttatggattgggcattgttttagtcactacttgaaggagaacctcttactcattatcagtctcttggaaatagcaactgattaagcctatatatactttgtgcatccagtgaaaatgtgataaatatgatgatcttttggtcagagaaggattctggaaactgcagtagtttgattagtaagacagtgtttaaatcatgattacttgttgctctaatattttagactttgaaagatgacaagatgtgatgtaggtgacaaagagcatttttaaaaatgggtgaaattggccgggtgcggtgactcacgcctataatcccagcactttgggaggctgaggcgggcggatcacaaggtcaggaaatcgagaccattctggctaacacggtgaaaccccgtctctactaaaaatacaaaaaaaattacctgggtgtggtagcaggcgcctgtagtcccagctactcgggagactgaggagaatggcatgaacccgggaggcggagcttgcagtgagccgagatcaccctactgcagcctgggcaacagagcaagactccgtctcaaaaaaaaaaaaaaaaaaaaaaaggtgaaatttaggcctatcaagatacttgggatgtaggaaaggaatatatatatatatatatatatatatatatatatatatatatatatattttttttttttttttttttttttttgagacaaagtctcgctctgttgcccaggctggaggctggagtgcagtggcatggtcttggctcacttgaacctccacctccctggttcaagaaattctcctgcctcagcctcctgattagctgggattataggcacccgccaccacgcccgtctaatttttgtatttttagtagagacggggtttcaccatgttggccaggctggtctcgaactcctgacctcagatgatctgcccgcctcggcctcccaaaatactgggattccaggcatgagccactgcgcccggccggatgttacatttattgagtacatattaagtactgctcactgttttaggtacttcctgtgcattgtcttttttaacctttcaactaagctaaatactgttgtccctgttttaaaactgggaaaaatgagcctctgagaggttcactaatacccaagctgacatagtttctaaacagaagacttgggattattactccgatgctcgcttttttgaaactactggtcacagtcgtttgtggttattggctcatctagatcaatcaattggatgaaacccagaaaatagattttgtcttcaacaataccattaaagagttgccttcacattaaaatttaataactacatcttatcctttgtactcttaatcacctgttttccctattttcttttccagatttctgacatgagggattttgtctcatttgctctaaagagtgaacctaaacattgtgtttaggtttgttattagttgctttaaatatatacacatctgtaaacattgaacttttttgatgcctcatctgtgttgcttatagatcattttccatcataattattttaaagtccttttaagaagtttaaggcctatctcatatatgtaatatattaatagtagataatcaggcctttggaagcataaatgatgtaagtaagttgggttgcagttttttcttatcaagaatctgcgtgtgtttaagtggcagtggagataatatttttatttgcgttgttatagtgttatctttatcatttagtttatattttctgccatttaaagataaaaaggttttatcttttatagctatagagtcatcttctgagccttaaaacacttgtgttttttttcttttcgccgtgtgggtggggaaaggggtgtgtggcaatggccctgtgctttgcctctgcctgagttacaggcgtgctttgtttgcctggctggggtttgtgtctcccatgctcaggagggtggaaccagtttcccagggcctgggccctacctattgtcattctccccataaggggatctgttacgtgtacttgtgggaccacacagtgctctgggcagataagcctcttcctgcctatatcagaaccaacatagcccacacacatctgggaaagcatgccagggtcagcaccccaggcgccctgtactcccagcccattccccttcttcttcccactcacctggaatccctgacccaaggctctacctattggttctaatattctggtggacagaatctaagagtccagcaagctcagaatctcaggacctcctcatccctttaggaaccatcaattaatctcatgatttcaggttgaaccactggagtcaatttcagaagttttggtctatctcagaaccttcagatcacactcaaaagcttggggacagcctcagaaccttgggacacatctcagcatacagggtcatcaatcttagaacttgaggtctgtctcagaaccttcatgcgaaactcagaatcttgggaagtcccaggaccttgtgcccggtattataccattggatcaattatcacagtcgcagaatcttgaggtccatcttggaatggtgcagtcagcctgaaccgtgggatcaagttcagggacatgagaacaatctcagaaacttctggccagtcctaggtctgaaaaccttcaaaacagcaacagactcttgcggtccatctcaaaacttgagattgtggtctaaaagggaccctcaagactatccatccagtcccttcctggaatacaagtcacctccacagcctccctgatctcgctgtctagtctttgctatgagccctcctcgatagggatacctggcccctacccactgcctgccttgcttctggatggctccagctactaaatgatgtctccaaaatgtgagaatctgaaatctgtctcctttttcccacatcagccctctgagacctctgcagagatttcaaggcaagacccatatgctcagggtaagctttgtcccagactgcccacactgggttcctcccctgacttccagatctccacccgcccttctgaacactgttatctgcaacacagttacctgtttatgcatttcaattttgagcctataggatatctcatactgcaaaggaaaagcccattgggaatgtctggggtggaggtggatgcccaaccctgtgctgggtgatgctgggggaatcacagcaggatacagagccccagaaccccatggggtcccagaggaggagcccagaggaggaagcgggaccatacctggaggggctgcctctgatctcctcagagactaggggtgcagtgggaggagaagataggagatgcctagagaccctggccccacagagatgcctgtgagaagagggaagattcctgtttcactattctcaagagctgggagaggcttctgagagagaacctgtaatcccagtcggcccaattacagataggaaagataaggctcaaagagggctcagtcctaccccagagtggttgggtgagtcaggactaacaagtcctctttcccattcccctgacatcataactctccccaccatgatgttatgttgctgcatttcagtcttctcactggccatcttctcacattccagcttgacactaactaggaaggagagagaccatgggggtcccacacaccccatatgagccaaagtgaaaaacattgttacttttaatctcatttcttctttgtaaatgattttttgtctctgaaattctgtgacatgaatcagtttagtcactttttatcttattaaatggagagaaaaattgcttaagagatatttaggtgtgttgttttttaaccctttttggttgtaaattgttttctttctttgttttagtaaccccagaaaatctagaagaaaatctagaagagaggtaggcagatcattggtttaaaaaaagaagcccaccaactaaatcttttattgagtaaagtattgtttctaggtagagaaagattagagaattgtattgagaattttactaggtttgggatttacaaagaggctaacatgcaaaaggcagtgctcttcgaaggagtcgtatagatgtggagactttatagcccttagggagatctacagacatccgctatgctgagttctgggaagctgctttttcccatgcttgcagcctccccgtggggtaaaggtctgttagttttgcataaatatttaccatatctcattttagctagcattgcttcctcacactgttagcactaaggagaactttgcttatccagcttgaaaaatttactgtgatcgatatgactaatctggaggatgttctgtcatctttgagcattgatgaagttaaaaagtcagattggcaaaaataatgagggggaaagcaaccggttcacagttgacaaacatttgcccatgcttgttttcccatatttatttttttaaacgagaaggttattacacaagcagcatttcagtcttgtcacacccaataaattattgttgcttttatatgtttatttgtatactagtcgtttacatttgcatttactatacttttacaactgtttccttattttgtaaccatgaacaccagcttctacatgtaaagcctcattctaggtactttatatacatcatatttaatagatataataattgtacaaggcaaatgttattcccattttacagatgagaaaaaaacttagattcaaagacattgattgactagatcagtatttcccagctataaatttttttggaaccaggttttaaattcaagtcttttagcggggcacagtacctgtagtcctagttacttaggaggctgaggtgggaggattgcttgagcccaggagctccaggctgcagtgagctatgattgtgtcagtctacttcagcatgggctacagagtgagactctgtctctttaaaaataaaaaataaaaaaacccagatctttttgactcttgattcattacatttgctactgtacccaattttatgttactccaaatgaaaatattcagccaaagaaggttatttaatctattttaagataaattacaggagtaatttctaagttgtgttacagggaatatccaggacactttaataggagtgtatttttttgactcatgagccctacaacattcaggcattcaaggccaaaggtagaatgtaaaatgatattaaaaggcaaccttcagactttgagtttattattttaaaaaagatccagcttattatggaaaaatggcctaatccattttattagtcaaaaacaatccaacatttgcaatttcatgtgattcaggctaggagcaatctatcagtatgactgcgtcttaaatcttgtcaatatttgataggattctactttaaaatttttgtgtttttgtgtctcttaccttctacttctccttcactccatgtcttttttaaaattttttatgtttttgagaccgagtcttgctctgtctcccaggctggagtgccgtggcatgatcttggctcactgcaatctctgcctcctgggttcaagcgattcttgtggctgagccacccaggtggctaggattacaggtgtgcgccaccacacctggctaatttttttttaagtagagatggggtttcaccatgtttgcccagctagtcttgaactcttggcctcaagtgatctgcctgcctcagcctcccaaaagagctaggattacaggcctgagccactgcgcccagcctccccttatctttttgcatgtacactttgtctttattgtcatcactaagcttttaatctttcctttgttaccccatctaggtcctctgctctccctcaaccttttacttatttctggttgagcccttttgtcattccctgcaattttctgaccatgtagtagatacccagtaggcttcctggattacttggtttttctgtattttgctaaaaagttactccaaagatgataccttctatttggacctttcccaccctttatatacctatctaggaggtagtaacccaaccattaatctctccatgcaaaatacatgtattgactaaaaattatgtgctaggtactgtaatgtttcctacccattattttacttaattctcacaattactctgtgaggtattcacaggtgaagaaagagaaagtttaagtagcatgcctagtgagtggtaaaacttggattttagtatgaatctgtctgacttcccaacctgcactgtttttttttttgttttgttttgttttttttgagacagtcaccctctgttgcccaggctggagtgcagtggcgtgatctcagctcactgcaacctcagcctcctgagtagctgggactgcaggcatgtgccaccgtgcccttctaatttttgtatttttagtagagacggggtttcaccatgttggccgtggctggttttgaattcctgacctcaagtgatccgcctgcctcaacctcccaaagtactgggattacaggtgtgagccaccatgcctggccccagcctgcatgcactcttaaacactatcctatactgccagatatggtcagagttgaatcagatactgtttctgccttttaggaacttcgagtctaatagaggaagatagagaactaagtgcacagggcacagtggagactgaaaggagaaaaatcattactttttggacagatcacagacagcttcatagaggagatgaatatatttgctgaatcctggaatgtgggatgtagttactggacaggtaagggatagaggaacaattcaggtaaaagaaacaatcaggtttttttgagacagagtctcactccatcacccaggctggattgcagtggcatgatcttgcctcattgcaacctccacctcctgggttcaagggattcttgtgcctcggcctcccaaaatactggaattacaagcacgtgccaccgcagctggctaatttctgtatttttagtagagacaaggttttgctgtgttggccaggctgtccttgaactcctgacctcaagtgatccgcccacctcagcctcccaaagtgctgggattacaggcgtaagccaccgtgccaccaaaataaggaatattaataaggacatagaggtgaaatagctcacattttcaggaactgcatatagttcagcatggctagagcatggaggttgatgatggatgggcacagcagttggtaaagttggagtgataggtggtaccagattatggaaggccttttaagtcattctaaggagtttggattttaacctctggattgtagggagccactgaaggccttcagtcagagaggcagtaagcgttatgttataaaagattctttcggtggtagcgtgaagaaaggattagtcttgagcaacagtttcaggggcagagaaaccaatagtgagacatttttcagtaatccatatgaaaaatgatactaataaattcctaaactgaagttgtaacatatacttaaaagcgaagagacaaagttattaagaagatactaagaataccagcagggtgaaaggtgtgtggtcaaagtgtggggctttctgggttgtgtccttgggtaggggttggtaatacttagcaagatagggaatgtaaaagggagaaggcagggttttgttttgttatttttgtttggctgactgataagatggaagatggagaagagaacagacatagtaagggatagatttagtttaagttactaaatctttagtttaagtattcactatctgttgtatgatagattatcccaaaacaataaacttgcactatccactatggtaaccacaagacaaatgtggctatttacatttaaattaattgaaattaaataaaattgaaaattcagttcctcagtgacactagccacatttcaaatattcactagccacatgaagccagtggctacagtactgttggttgatcatagaacgttttaaattattgcaaaaagctcttttggacagtgctgccaaacatttatcaacgcatagtttactaagatcagaaatcggtgagcaactttgctgggtggttctgcttcaaggtttctcatgaggttgcagtccaggtgtctgcaactagaagcaagggcttcaggaatctgaaggctcaactgcacctggtgggtccatttccaaggtgacttactcatgctggtcaagtgagtgctgattgttggtaggaagccctagctcctctgttggtaggtggacttctctgtggggatgtgtgaggcagctggctttgccctgagtgagtgattttagccagagagggaggtagaagccattataacttttgtgagctgacctcaaaagtcacactacatcatttctataatctgttggttacacaggtcagcactattcactgtgggaagaaactatacaagggcatgaataccaagagtcaatggggcccattttgtttttttgagataggatctcactgtgttgctcaggctggggtgcagtggtgtgatcatggctcactgcagcctgaatctcccagcctaaagcagtctctcatctcagcctcccaagtagctgggactacaggcatgccaccatgctcagctaattgtattttatttttatttatttatttatttttggtagagatagggttttgccatgttgcctaggctggcctcaaattcctcggcacaagtgatctgcccaccttggcctcccaaagtgctgggattacaggcataagccaaagtgcccagcctattggtggtcattttggaggcttcccaccacaaatacttacggaatatctgggtacaaatatctagtggacaactaaatgtataggaatgagttcttagctagtgctattatatttgtgatggtagttgaagaaacttgaataggtgtagatcaacaaggatgagattgaaccagaaagacagttaatatagtatcttgggtcacatgtttggggaggacagaagtactttcaaaggctggaggaacagctacaggggagtagtagtagaacaggcaggggagtacattataaaggaaacttgaagggatgaaagttgaaagtagaatgtaattaacattgttcagtagttaaataagagtaaaacttaacagagtcattctttcaaaaaatatttcttgaatacctgtgtggggaaccagagaaagattggtagataaataagaccaagtctctaataacacgtaatactatctgaggagacaagtttgggaaggtttcttggaggaaggtaatattttaaggtagagactctttaaagggtaaggaggtgagttgggtattttaggggtgtggtggtagagatatggatactaaagtggacatttcaggctatgttagatgtggaacactgctaggatatgaagttttgtgatgagggaaagtggtgagaaaagaggctggaaggccaattagagtagtcttgaatacatgcatgttaaggaacttgcctttatcctgctgactgtttcccatacttaaatttggatactactttagtgatttgccataggcttataacccctaaactgtaagttactaaacatttttctttaatattactctttattattttatttatttattttgagacaaggtctcactctgtcactcaggctggagtgcagtgatgcggtcatggctcgctgcagccttgacctcccaggctctagtgatcctcccacctcagcctcccaagtagctgggaccataagtgcataccaccacattggataatttttgtattttttgtagagatgaggtttcaccatgttgccccaggctggtcttgaactcctaggctcaagcgatccgcctacctcggcttcccaaagtgctgggaattcaggcgtgagccaccatgcctggccagtaatattactttttaaacttagaaaccatttccagagggaacttcattgtattgttataaatagaaaaccagtattgtttgctacatataaaagagaatagaaaaaatatgaatgattattacgttaaaaaaattaaaagtggaatgtagcaatgcatcctttgatatagaaaaatgcccacttggaaataagttcctcagtgagaatactatttttggtcagttagcaataaaagggcctttgcttgaatagtgtttggtttctacctaagatgagattttaaggtcattaagacaattccatttttaaattttgatgttaataagcaccaagaatcacaactctcaagtctgcgtacttggaaagatcataatacagttaatggtcaactttgtccaactttattgttaattcaagcactaataaaaattaagcccttttgttccaagaagccatctaaagtagtttatagcaggggtccccaacccctgggccagggctgcacagcaggaggtgagctgccagggcgaaagagcattactgcctgagctccacctcctgtcagattgctggggacgcattagattctcataggagtgcgaaccctgttgtgaactgcacatgtgagggatctaggctgcacactccttaagagaatctaatgcccgatgatctgaggtggaacagtttcatactgaaaccgtacgtacactcaaatccccatctgtggaaaaattgtcttccactaaatccgtccctggtgccaaaaaggttggggtctgctcatctatagaatctattcttctgagtgtgtcaagttatttattggacatctggaaatggagaagggattttttttgtctactctttgctgccatccagtttgggaaaattctcgcaaaaattttcaaaaatttcaagcatcttttacaattttcgaaatatttccagtgagtttttcagaggaatccttaactggtcctttcagagaggaaaaaagtatccagctcacctacatatctcatagttctagtttcacatttatcttgttcactttgttttgtacgtggaatacgtaaacttgtcaggataaatttaggttgttcacataagtagatatatttgtcaagatatgcttatttgcagagcctgtctcaggcatgcacatgatctcacaaactgaagatttcttccagaaatatttgaaatttttcctgcagctcaaaaggatgcatgaagagttttccactctttttgccaaactctatatgtagccccaattttgaagttacttttataaggttttaaataaatggttttgaactgtaatgactaacaaaaggcatgtgaatgatagtgctagagatgctgccaccaaagtaccaagaaagaatatcatgcttgatgataaaataaaagctttggagtgtctcaaattggctgaatacatttaatgagctattagaggaaacatggtaaagatggatggtcatttagaaattctaaagtcctgtaatgttgaggaagctaaacattatcaaatcttggaagaagtaatcaatataggaagaagaaggaggagaagcaatactttggatactaagcaatagtttcaatactaagttgaaattacttagctaacctcaatttaatggactcactacatttcctctgcagaacatgacttttacccagtgagttaaatgcttgtgtctcatggctattttgtagtgtgtctgaatgcttctacttcgtccagttgaattgtataatctcaacccgttgtacttgaattggaattagatgatttagttaaatattatgaaaactgaaaactgatgaaatctgagcaccaaaaagaaagttatttctataaacagtgagttgtgtgtgctttggaaataagagtagagacttgtcactgaaaaaaaattctgtcaaattagacgtgtatacaaaacaattattatttggaaagtatcttctagattattatgaatgtctttcgtttcttgctccactctaaggaaacaggaaataaatcatagctgatatattttaggacagtttataccagaaagctgatgggacactccaatcaacagacccctacttaaagaaacagccaggcgcagtggctcatgcctgtaatcccagcagtttgggaggccgaggcgggcggatcatgaggtcaggagatcgagaccatcctgactaacacagtgaaaccccatctctactaaaaataaaaaaaattagccgggcgtggtggcaggcgcctgtagtcccagctacttgggaggctgaggcaggagaatggcgtgaactcgggaggcagagcttgcagtgagctgagatcgcaccactgcactccagccttggcaacagagcgagactccgtctcaaaaaataaaaaaagaaaaaaggaaaaggctttgatcctacattttaaaattggcaaatgaatgtacatttacataagttgaaataaagtttaaggtttgtatgaatggtttttaattatttcctgctttaactattcttttccattaaatgaccaaccactggtaccagtggattggataagacagttggcactgcgtggataaaggaggtttaaagaaaaggaaacatgaaatgccttctttttgaggctgctacaataaccaagttacaagtgtgctgattaatttattattcctgtttccagaaatgtcttatttgtatttcatttttaatatttttaaatttaatagtttacatttcccccactagtgttgccttctatttgtagcaagttaatactggttttctatttataatagtgagataaagtttcctttggaaaggaatgttacctttaaagaaaaacattaggtgactaataatttggtgcttatgtgactgtggcaaatcatgaagatagtattttaagtatggaaaacaattgctaaccagcaagataatgtcaagttccttaatatgaactcacttcttggcctttgtctaccttctccagcttcatgtcttaccactttcccttattatggacttcatgttgatcaagtggaggctccctctcctcaaggagagtccctaggccagattcagaagatggttggtagagaggggatttgatagcttctgaggacagtgctttggatggagaaatatcatgcaacttaggacagtgctttggatggaggaatatcatggaactttagttttccagctttattgagctttgcctgtgatattcacttgtttggggggctgtttggagacagggtctcactacattgtccagacacaatcaccatgtactgcagccttgaagtcctgggcttaagtgatcctcccatttcagcctcccaactagctggaactacaggctcgagccactgtgcctgactcttactcacttttttgttcccaatacctggaagaagatcgtcagtctgtaaatatttgaaatctaaataagggttatggtgctgtagtataaggccaaatcttgggcaccaaacaaaaaaaaatttagaaaaatcccttagcccatcccatgctgtgctgggagcttcatctttctttttaattgcaatttaaacgatctactgctacaagagggttgtggtaaagcagaatttcttatactgtgcaggtgggcatgtaaattggtttaaacttacagaaaataatttgacaatatagttcaaaagcctaagaaatgtttaaactttttgaattagtaatgccaattttggtatatatctcaagacattaaggatatacagttttagctgtcattttatacaaagagatcacccacaccattattttagtaggggcaaagaggaaccaatgtaagtctggtgcctctgaagaggtagacctagaaactgggatgacaaggaactcccaggggactgctgttaataaattactttatgtcatttgataaaatatatgtaagcattaaagacattttcaagtaaaccttagtgaggaaattgttcatgatctgtgaaaagtatgggataaaacttcaaatataatgccagttacatttttaaaaaacattcatgtgatgcttttaaaaagacttctaggacatgtaccaattttttttttttttttttttgagccaagtcccactttgtcgcctaggcttgagtgcagtgggcacaatcacagctcactgtagcctcagcctctcaagtagctgatactacaggcacacaccaccatgctcagctaattttttaattttgtgtagagacaagctctcactatgttgcccaggctggtctcgaacttctggactcaagtgattctcccacattggcctcccgaaatggtgggattataggcacgagccactgaacctggcatgtactactttttaagtgtttctgggttgtgagattatagatgaattttgttttattcttcacactcatatgttgttttctaggcttttaactatgtgtatatatatatattgcctttgtcatgagagacacttttgtttttaagtgaaacctctgtttagtttttatttatttatttgatctttattttaatggaaaggtaactgtgctggtaagctgatagatgattggaaggaataattcttgagactaggaatgcaaatgaaagactgctgggagatatgagaagctcctgaactagggcagtggtgataggattggagaggaatatcgtgatcagtaagacataggaataaaggaaaaagagggatccaggatgactcccaagtttctgggtgtttaaatgtaatacatttgagatgaaagtttggctcttaaaaaatattcttatttggggaatgtttaaatttagtgaggtcattaacaacttcagattccttttatacttcaattctttaaattctatatgttgccaaagatcctacttctaatttgttagggttaacaagaagaaagatgatatgtctgtgaagacatgtttctgacatctgtcaccctatggattgccagttgatagacctggttgtcttgataagtattagctgactccccaaccagtttatttgcaccacttctgaagcaataagcttggttgaaaaagggcacctcccaagtagggaaggataatttttaggtcaaattatagaaattgcatgtatccctgttaacacttccaacaccaacaaaaaaatagacaggaaaatgaccctaccagctaattctccattataagactttgaagaaaaggttccattaaaaacagaaaagaggctgggcatggtggctcatacctgtaatcttaacactttggaaggccaaggtgggagaattgcctgagttcaggagtttgacaccagcctgggcaacataacaagaccctgtctctacagtaagtaaaaaattactggatgtggtggcatatgcctgtggggccagctgtttgggaggctgaggtggaaggattgcttgagcccaggagtatcaggctgcagtaagccatgattgtgctattgcactccagcttggtgacagagtgagaccctgtctcaaaaaaataaaaccttgaggacccaaatttgatttaaatttagatgtactatctgctttgggagagttactttattattatttagtagagacagggtctcactatgttgcccaggctggtctccaacttctggccccaagcagtcctcccaccttgggctcccaaagtgctggggttacaggcgtgagccaccaaccctgcccttaagttatttttttgatcttttcatgacatgctgtgggcaataaaataatacagtgggtgatctgttgttgcaattcaaatatggagttcctttttcttccacaaaagtattggctgatttctttctttttctggctgtgagcaacaggtaaattaacatgaccatggtctgtccccagcgtcttgactcagatttcttaatttgaacttttccatcttctccactccaagatcacatgacaacatccaacatcagtggatagaaataattagaggctggatgaggtggctcacgcctgtaatctcagcactttgagaggccgaggtgggcggatcatttgaggtctggagttcaagaccagcctggctaacatggcgaaaccccatctctaccaaaaatataaaaaattagctgggcgtggtggcacacgcctgcaatcccagctacttgggaggctgaggcaggagaattgcttgaacctgagaggcggaggttgcagtgagccgagattgtgtcactgcactccagcctgggtgacagagtgagactccatctaaaaaaaaaaaagaaatttaataagtcactgctacactggcaaagaagggttgagtagttttaagaagcttagttgctgtccaacagtcttattgcatctgattcttttggtgcttgcttactcaagtagggatcacatagcatgggaaggaaagagcagatctgtgattctgttgtttacatctcagaattgtggtttgtgaatagttttgaaatttttcttatagttttgggagaaatttgttaacggaatttttaaggattataggacagcacaaaataatttctcttgtttagatgcttttaataataaaaaaaatctgttaggatactttttccttttttttttttttttttttttttttttttgaggtggagtctcgctctgtcgcccaggctggagtacagtggtgtgatcttggctcactgcaacctccgcctcctgggttcaagcgattctcctgccttagccttctgagtagctgggattacaggcgcatgccaccatgtccggctaatttttgtatttttagtagagatggggtttcaccatgttggtcaggctggtctcaaactcctgacctcatgatctgcccaccttggcctcccaaagtgctgggattacaggcgtgagccaccacgcccagcctagaatactgtttaaatgataaaatagctgagtgcagtggttcatgcctgtaatcccaacactttgggaggctgaggcaggaggattgcttaaggtcaggtgtttgagactagccctggcaacgtagtgagaccctgtctctacaaagtaatttcaaaattggctgagagtggtggcacacacctgtagttccagctgtttgagaggctgagttgggaggattgcttgagcctgggaggttgaggaggttgaagctgcagtgagctgtgatcgtgccactgcaccccagcctgggtgacagagcaagacctcgtctcaaaaataaataaataaaagataaaataagaccgaaagatttcattatgggatagagaagaaaactaatatggaatttaagataatattcttatatttgagtggcctctttttttgagacagggtctcactcttattgctttggctgggccacagcggcatgatcttggctcactgcagcctggacctcctgggctcaagcaatcctcccgcctcattgtccatactgtctagctatctccatgataacaacatcatcttatatcatgactactgactaaaatccttagtagctgggactacaggcacatgctacaatgtctggctaattttttaattcgtttatagagatgggggtctccctatgttgccgaggctggtctcaaactccaggcctcaagagatcctcccaccttggcctcccaaagtgctgggattacagacgtgagccaccatgcctgacctgagtagcctttttatttaaagggaatcggcatttgtttattacctggtatgttctgagtatcaggctgtgtacttaacctcacttaatcctgacagcattcctataaagcagatacctaacaattatttgtgaggaaattaaggttcagtgactttccataaatttgcttatggtcacacaatccattgagtgcttgtgccaggttttaatctcagtctgaccaataccaaaactcattttttctatgtatgtttcccttttagaaagattttatttttttaattttaattttaattttttaacttttaggttcggggtacatgtgcaggtttgttatatcagtaaactcttgtcatgggggtttgttgtacagattattttgtcacccagttactaagcctagtacccaaaagttattttttctgccccctccctcctttcaccctccaccctcaaataggccccagtgtctattgttccctagaaagatttcataagtaaatgtcatctagcctgtaaattatttttgtttgccagcatttataatataggtggtcattctttaggtgctgaaacagaattggttttgtccttagtgtctggctgtctccaatgataacaacatcgtcttttatcatgactgctgactaaagtactatattctcaaatcttcttttcttctttttttttttttttttttctgtgacagggtcttactctgtcccccagtctggagtgcagtggcatgatctcagctcactgtagcctctgcctccagggttcaagtaattctcccacctcagcctcccgagtagctgggactacaggcgcacacccgcacaactggctaatttttatatgtttagtagagacggggtttcaccatgttggccaggctggtcttgaactcctgacctcaagtaatctgcctgccttggcctcccaaagtgctgggattacaggcatgagccatcccactcggccagatcttttgtttttaattgaaaacttataatacatttcagagataaaggagagctatttcagaactggtgcttattggtaagttttaaagagttaaagtcagtgaactggtggtataagccatttaatcattatgtttatcattttatagatactaatcggagtaatgcagtttcaacaaaagtagtttattttggggtatacaagaatttttattctttaagctaattaattctaaatttaaaagaaggaaaacacctgagaagcttgcgctcttagtgttactacacagaagtctcaatgtagctgcaacatctgattttaaaattttcttttttcgtcttatacttggaatatttcacaataaagtaaaaagaaaatgatatacatccatgtacctgctacttagtgttatctttttgggggacgaggcaagcaaataaaaattagagatgaagtcgaggctcccctgggtattttcccccgatcctgttctcttctgcccctttccagaagtaaacatcatagtaaacttggtgtttgttgctcctatgcatgtttttatactttggctatatgttatgtatcttcaaacattatggaaatttttgcagatttttaaacttcctaacatttgaattcatgttctatattcagcaatgtgtttattaacaaaatatcaataaaaattactaattataactgttactattaataatgaatattaataaaatattatgaatatgatatgaggtagggattgagttttattctttcatgtggagaatcagtcgtctagccccattcactgtgcagtctgtcttttccctactgatgggtagcactatccttgtcatacataatgtttccattatttgtaggtttgtttctgagctttctaatcttttcccttggtttgactatttctgtaccgacaccaaactgttcagattactttagcttcataagcaaagtaaatctccttaccttgtttttcttcttcaaaattttcatcgctattcttagctttttctttttccatatgaattttgggatcagcttgtcaggttcccttaaaagttttatttttttttaacattgtaattgcattgaatatttagtttagtttggagaaaataggcatatttatgatattgtcttcctatacatgaacgtggtttttccttagaaattccagatattcccttatggtcttcaatagtaatttataattgtatccaaaagtcttaaaacttttttggctaagcttatttctaggtactttatgattttctctgcttttagaatggttggtcagtctctttctttccctctcctcctccctcacttattcttttccttcctgtttcttccttcccatcccccattccaacctcctttcattttttttttctctctccttccctcccttatcaccttttaattttatattgttttggctgacagttctatttaaggtagtgtgttatagagaaaagtatatggaacttagagtcaaaattgctggaaatgagtccccgcttcgtccttcaagaattatatgataattaagtcaacttttctgagcctaattctcttaatctgtaaaaggagaatatttacttttatactgtctacctcacagaatcaagtgagatatgtgcatgaggttttttcctaattaaaaattcagtgctaaaaagagttctttctaggggaaaaaaatgccaatttcccccaactaaaagtatagacatttattaaaactgtatctttagggctgggtgcggtggctcatgcctgtaatcccagcaatatgggaggccgaggcgggcggatcacctgaggttgggagtttgagaccagcctgaccaacatggagaaaccctgtctctcctaaaaatacagaattagctgggtgtgctggcgcatgcctgtaatcccagctactcgggaggctgaggcaggagaattgcttgagcccgggaggtggaggttgctgtgagctgagatcgtgccactgcactccagcctggtaacaagagcgaacctccgtctcaaaaaacaaaaaactgtctttaaagaagaataccttaatacataaacttattattttgactcttaaagattataacccttataccccacttcctaaaaaaggatgtgaaatggtttaaagggcacgtaaacatacactcacctcagttaaagatgttaaaaatagaaaatcaagttattacagtgagatcagtgcaaatatgataattatgagggctaatacagccattgtaattaagcctctctgctttcaggattctgtgggaataaggtaaatatgatttggttctattgttggatgtatttcctcctttgagacaaacctaattttactcccattaaattaaaaaaatactgtccaccaaggtttcaagacaatattgggaacaatatctgctacaacagtttcataagtgaaagagcactttttcaaatggttttttgaatgaccgttactaaaaatctgaggggaaaacagaaagcagcactcaccaaaactgatttctttggaaaaactaaaccaaggttatttagatagcttatgatctaatttgtcaggcactgagctggtttataacctagagcagtgatgctttcaacatttttgtgttaacacatatgaacttttgaatactaaaatttttggtaatatgttgaaacttccaagggaacattagataaagtaatagtaactataaggtaaccactagtacagtaaaaatgccttctagttacaaatgaatccaaagcaatctctattttacttaacactattaagcactgcagtctgagtttgattagaactgtttactctctgatctcctctgatcttttttttttaattcaggaaccaaaatatttatatgttctaatatagatataccatctttaacattggcttgaaattatgtaatgcctctggattgtagttatttgtgcttcactataccctgtcatatactggcccagtacaaagttctttctgacaagcctttctaccagtgtgttattaactagtttgctttgtataatgcagttctgctctcaaatacatctaggcaagtaaccaaaggaatcctaggttaactttctgcatttgaaagatgtatttatggaagactgaagcttattttttatatggtaaggcaggtgctcagtttttatggggctttttttccctataatttttcaactttttgtaaaaagcagacaggatttatgataagataggcctgagttcagatccaggctctaccatttgttagctgaacaaccttggaaaagttatatagcttctctaccttagcttttgtctctttatccccaatatctcttatcatgtctacttcataggacttcagatgtgaagtttttaaaaattatcaaactgtaacttattgataattttctgcttaaggtcactctaactgaggaacctacccctagaattaaaaataaatgcacaaaataagctattaataataaatgttgaaaaaagctattccgtattaccagtataatctaaactgaaacaagattttttcttagaagtaattttttctaagtataacaatgctttaaaataaccattatataaaatttctgacatagataaaaattagaatagcttaatgaaccttcactgacctgttaccagctttagtaataaaatacagtttagattaatccttttcaaccatataagatataaagtgacaaggcccctcccctctcccagttgtttaatatgatttacctgaggtagccaccattaacttcctttacacaaatgaaatcaccccataggtgctgttttgtagcttgacattttcatttaacaatatactttttaaaatatgttttatttccatgtgagtacctatgttctgtggctatacaacattctgttctctacaatgttctatataatattatggcagcaaaacacaaaagagtgaaatgagggatgtttgttttatccactgctgtgttcccaacacctagaacagtgcctgcacataatagatgctcaatacatatttggtgaatgaattaacatctagttaggaaatgtatttctaacttggaaatgtatttctattattggtacgatattctattatataattgtataatgatttatttaactagtagaataatgatggatggtaggactttgggtttttttcacctttctatgtttttttcccccttctatgtttttttcccccatattctcttcagggagcaactattatcttgataatggtggcaatttaagaaactactttgagaaaataattaaaatatgaaaaatggattttttgtttttgtttttgagacggagtttcgctcttgttgcctgggctggagtgcaatggcgcgatctcggctcaccacaacctctgcctccaggtttcaagtgattcccctgcctcagcttcctgagtagctgggattacaggcatgcaccaccacgcccggctaattttgtatttttagtagagacaaggtttctccgtgttagtcaggttgggctcgaactcccgacctcaggtgatccgcccgccttggcctgccaaagtgctgggattacaggcgtgagccaccgcacccggccaaaaaatgtatttttatggacacccatagctaaatgtctttccatctagtggctggttaaccaagcatggttcctcctgtttcctttccctatgatcatttcagagtataaccattgtttagtgtaggagagatgttatgacttttagatatgctttttttcataaaaaggaattgcctagttagaattttttaaagatatctcacagttcagcagttttgacattgctggggaaattttatccagggatacagaagaaacgttcattcatttttatttaagcacctataaaaagtaggggggtacttctggcaatacagttgggttactgtttgtggctaaatatgtgtgtgaacattacgacatttgatgaaaacagcttcattgagctactgagctctccagctgatttttcttcttggccttaaaggtttacaaggctaagaatcaatctcctctggggtagatggccttacggattttaaatatgtgttgtgataaaagtgattttactctaatacagcatagtacaagttaacttccagtatgcagaattgacctcgtgaattttagtttaatgatctcagttctcatgaacttgcaaacatagaaaaaaaataaatatttttaaaaaacttttctttttaaattgtgaaaaacgtatatgatggttacagcaaagattatgcttttatgactaattcattacattgagtcatacatattaatgattcaaattactaacatagctctattaaattaaatctaccatacagtatacaggtattctgtactttgaaatttcataaatttttggatatcaactctcagaagggtatactagtaatttgcttttacccacaaaatcttcagatttgtcaacaaaatgaacgagattggtattttcactttagtttctcagtgaaaataaagaatgggtagatgaatggtccaaagagctaagagagaagacttaatttaaactcaaataaacatgcccagaatgaccctctctttttctgcccttcctcctgccacagttagccactgtatgtctcaggttttaggcaaagtgagtcttcttatcatggaaactgtgaacattcattaacaactggttttactttgaaacttaaacagcaaacaccaaagagtgaattgttggtataatccatgggagtcttgagattgacgtcagaacaccagtacagctgtataagcattgggaagtatttttaacatccgtgttagatcatctttttgacctttccttttatgttttctctttttccattaaatggttaaaaaaaagagctttacaatattttctaccaacactgtaatgatattcttaaaaaaagcacccgtacaattattttctttgttcctttcccctttgcaactttcctttacctgtagtgttccaagttctgatggggtggcctttttttttttttttaaataaaaagtttgtttttgagaacagggctagatttgccgaaaatgagaagctagaaaataacatataccccataggcatgctcagagtcccctattattaacatattacatttgtgtggtacatttgttactgaaccagtgttaacattaatattaattaaagtctgtagtttattcagatttccttagtttttacctattgttctttttctttcctcagaaaccacattatatttagtttgtcatgttccttagcctcctcttggctgtgacagtttctcagatttttcttgttcttgatggttttgacagttcaaatgagtactggtcaggtttcttgtaggatgcccctatattagaatttgcttgatgtttttcttacgatttgactggagtatgggttgttggaaggaagatcacagaggtaaagtgacatcttcatcaactcatgccaagggtacttaccgctaacatgatatgtgactattgatgatgaccttgatcaccaaaataatgtttatcagatttctccagtgtaaagtattggaatgttctggtaggcatatcctagttaggttaattgctctggtaattgcttgggctttagttattaaataaatcatcatattggtatactgctcattgaaatgttaaatttttttttttacaaataatgtgttcagagttgagaattagattttttaaatgttcagattgtattttcaaattgtatttttgaaataaagctttcctttcctgtcgaattctaaagattttgtttatctaagggaacaacttaggttcgtattttaagtaggaagttagagagcctggtcagtttatctgcaatttaaattctagacactgagacttatttccttcattttatcttttaaaaaatagactgagatataatttacatataaaattcaccattatattattgttaatttttatgggcataagtatttatatttatggattacatgcaatattttgagacagggatacaatgcatgataatcacactaaggtaaatggggtatctattacctcaagcatttattctttctttatgttacaaacattccaattatactcttctagttatttttaaatgtacaataaattatggttgactgtaatcactctgttatatcaaatactagatcttattctatcgaactatatttttgtatcctttaacaatcccaacttccccaaccccccactacccttcccagcctctggtaaacatctttctatctccgtgagttcagatgttttaatttttagctcccacaaatgaatgagagcatgtgaagtttgtctttcggtgtctggcctatttcacttaacataatgaccttcagttctatttatattgtggcaagtgacgggatctcattgttttatatagctgaataatactccattgtgtatatgtaccgcattttctttatccatttgtctgttgatagacacttaggttgtttccaaatcttggctattgtgaatagtgcatcaataaagataggagtgcaggcctctttgatatactgacttccttaagttcactcattttaagtgtgtacttcgatgagctttgacaagtgtgtatactttttaaccaccacaaccagcatagttaagatatataacatttccatcaccccaaaaaattgtctctgctttctgtcacaatagttttgccttttctacttcatgtaaatgaaatcatgtacagtatgtaatctttctgtgtctgtcttctctgtctctttttttttttaaagacagtctctgtttcccaggctggctggagtacagtggcgcaaacacagttcacttcaggcttaatatcctgggctcaagtgatcctcccacctcatgctcccaagtagctgagaccacacaggtgcacagcaccacacctagctaattttttagtattttgtagagatggggtctttctgtgttgcccaggctggcctcaaactcctgggctcaagtgccctgacccctgcgaagtgctgggattacaggcatgagccactatgcccagcctttcttctctttttttaggcttaatacttttcagatgcatccaaattgtttcatataatggtagtttgttcctttttcttaccataatagtattacattgtgtgaataagtcagtttctttatccattgacctgttggtggaggtttggattgtttccagtttttggctattttgaataaatctgaacattttcctgtaagtttttgtgtggcatatatttttctttctctttggtaaacatctcagagtagaattgctgagtcatatggtaaatatatattaacttttaaaaaattcttttatttatttttttagagatggggtctcactatgttgtccaggctggtcttggatcagccttggttagggatcctcccacctcaccctcccaaagtgctgggattacaggcatgagccaccacacctggccttgattaactttataagaaactgccaaattgttttccaaagtgcctctgtcattttacattcccactagaaatgtcgaagagttttacttgttctacatcctcatcaacacttggtagtatcagtctttttaattttagtcattgtagtgggtgtgaatggcatctcactctactttttatttgcatttctctaatgatgaatgatattgaggacttttcatttgcttattgaccttttgttctcttttgtgaagtgtctgttcaagtcttttaagaagttggcttgtctttgtcttattgagaggtaaggtatgggtcctttgtcagttacatttagaaaatgtttttctttctgtttgtggcttgtccttttatttccttaacaatgtctttcaaagagcataagttattaattttgatgaagttcagtctatcaactttttattttgtattcatgcttcttggtccctatcgtaaatatcttgacttaacccaaggttgcagaaaatgtcctcttaattttttctagaagttgtatagtttagctcttatgtttaggcctatgattcatatcaagttaacatttgtatatggtgtgaggtaaggattaaagtttgtgcgtgttttggcatgttttccagcaccatttgcagaaaagactgtccttttcccgttgaactgctttggcatctgtgttaaaaacttaatagactgtctgtgcatagttgtatttatggtttctttattatgttctgttgatcaatatgcctgaacatattgattgatttattaccttagctttaagtctttaaataaggtaatataagtcttccaattttgttgttttcctaaaaattgttttggctcttctagatctttgcatttccatatgaatgttagagtcagcatgtcaatttctatttacagaaaacaggctgagattttgtggttgtgttgaatctggatcagaatgtggagaattgacatcttaaattaggtctcccaatccattggcataatctttctctccattaatttagtagtcttctttaatttctctataaacattacatagttttcagcatacagggtttgcacatggtttgttaagtttatgtgttttgaggttataaatagcatttaaaattaatttttaattctttattaataatatatagaaatacaattgatttttctatgttcatcttacatactgttactaaacttgctttttggtgctttttttatatagatctctggagttttccataatgtcatgttattaaaaagttttactttcatttaaaagatgtaagccttttatatatttattttcactgtcttactcatttggctgaaatgttaaaagaagtggtgaaagcagacatgtagacatcttttcattgttctcaatcttatggaaagcattcagtattttaccattaagtacgattttttttttttccatactctatcagtttggggaagttaccttctattcctagcttgtaagaaattttataattaacagatattgaatttagtcatatgctgtttctgtatctgtttagatgatcatatggcttttctgttttctttcttttttttgacttgccaggaggtattttcatctgaggcttttctttcttagactggtgatacagtgaattacattgatttttgagtgttaaacctacctggcattcttaggataaaccccatttggtttatcctaatggtctctttattatgtattatgtattattctttttatttattgatagatttggtttactaatattttgatgattgttcttgttcctttgttcctaagggatatttgtgtttagttttcttgtaatgtcattgccttgttttgatactgagacagtgttggcctcagaaaattttttgggaagtgtcatgtgttttcactttcatttgtcagatgtagaattgttatctcttcctttaaatgcttgtgataattcaccagtgaagtgagttttctttgtggaaatgttttcaaccagcaattaaattcactgccccctgagagtacccactattctgacttctagtaccatagactaatccttaaactttttttggattaattttttatttagagaaaagttgcataaataacacagaaaattcacgtagagttcccatataccctacacctagttttcctgattgctgacatcttacattattgtggtatatctgtgaaaactaagaaaccaaccttagtacatactgttaactaaacttcatacttcatttggatttttccagctttttcattaatggcctctttctgttctaggatcaaatttaggataccacattgcctgtagttttcatgtttccccagtctcttggtttgtgacagtttctcagtttttccttgtttgtcacgaccttgccatccccgaggactttgtagaatgccccccagtctgcgtttgctgctgttgctcggtattagactgggttatgcgtttttggaaagaatcctcttttcctctcatcaggggtgcatgatgtccacgtggcatcactggtgatgttaaccatgaccacttggttaagatagtgtttgctaggtttcttcactatactctgttttttgggaacacattactaagtccaacccacactttaggaagggggagatatctacatacatggtttgaaattcttctgtaaggaagatttggatctttccccacatttatctgtttattcagtcatttatatcagtatggactcatgtatgtttattttatactttgagttctaatgctaggtttcttttcttttgcttaaattgttccaactttggctattgggaaggttttccggttactgtttatgtccctttcatatgcccctatccttttgttttttgaacatctcctgacgtggtactagaagatgctccaggctcatcttgtattttctttgcatcagctgtagaatcagccatttgaaggaactagcattccttttatttaggaaccaaaatgtagttactaggtgtgctcattgctattggagtatcgttgcttttaggccctctcaggggacagagctaggtaatatctgtgtgaatactaacccatgtatacacatacatctctaattgtttctatatgtatcagttggcatatatgttaagttaaacatgagttgatattgatgtctctgattataatccattaccacaaggttcactctagtcctcctttttaatctgtgacttccttgtctgaccataagaaacctggctccagccaccccattatccatccacttattttttcaacctatgtacacatgaaaagcaaatttagaattattaccccataccccatgagtacagtatttatgtacagtttcttttgtcattagccttacaatttcaagtcaaaacaccgtgttccaaagtttgttaggtaagctcctttttcaccgccccttcagtgaagttatgtcatacatttgtaatgcagttagtttcatttgtcgcaatccacatttcatcttgggatcctctgacgttttggttgatgttagtggttgttgtttggttaacatttgttgaagttcactctttgtactgtgccattctgtgggttcagacaaatgcaacgggtcatgtattcaccaccctaatgtacagcgcagatcctgcaccctaaatgtccccctgtgcatcccgtttgtagtcaaacactctcctctcctctagtccctagcaactactaatttattttctgtgtctctacttttgcattttccagagtgttgtataaatggaatgatacagtctttggatttttccatgtagtaaaatacatgaaaaatccaaagattgtatcgggcttctttcatgtagtaaaatgtatttaagattcatccatgttgtgtaaattaatagttcatttgttttaaaaattgttgtactattccattgtgtggatgaatcataatttgttttttcattcccccattaaaggccattgtagttactttcagtttttggcattaggagtaaagctgctgtaaatgtccatggccaggtttttgcatggatataagttttcaagtcccttgtgtaaatacctaagagtatgattgtaggtcgtatggtaactctgtgtttaactttcgactgcttttgttctttatagaaatggagttgtgcagtatgtgctcctttttaatctagcatctttcttttgaattgtttatgacatttatctgtatattttgagtggtcataattcatttgcattattgattaatattctaatgtgtgaataaactacagttttaaaaatccattctactgcagatggacatttagatagctctagtttgggactgttactaacagtgctgtttaggaaccttcacagacatgtatttttgtgaacatacatatacatttctgcctagttgtggaattcgctggtacagctttagctgattgtaccaagtaattttctggagtgattgtaccaatttatagtctgatcagcggatgtagtttctaggtgcttaatgtcttcatgagtactgtatgtattcattcattctatttctctctctctctcattgtggttttaatttacatttccttaaagttgagcacctttttatatgtgcattggttatttggatattcagaaaaattaagaaaattgtaaatttcttctgggctctgaaagcattggggtttggaataaggggtggcttccattaggaaaggcagtaagggggccgggcgaggcggttcacgcctgtaatcccagcactttgggggccgaggtgggcagatcacgaggtcaggagattgagaccatcctggctaacatggtgaaaccccatttctactaaaaatacaaaaaattagccaggcgtggtggcgggcgcctgtggtcccagctgcttgggaggctgaggcaggggaatggcgcgaacccaggaggcggagcttgcagtgagcggagatcgcaccactgcactccagcctgggcgacagagccagactccgtctcaaaaaaaaaagagaaacagtgtctttgggggagagccaggtgttggtgaaggcagcgtttggagtgcattctgtgaagaagttaagagtgtagtggtgtttggtttcttgtagcaagagtcctagagcagtggtccccaacttttttggcaccagggaccggttttgttgtagacagtttttcaatgggactgggagggtgttcgggggagggcagtagtgggatggtttcagggtgattcaagcacattacatttattgtctaccttattttcattattattacattgtaatgtataatgaaataattatatactcaccataatgtagaatcagtgggaaccctgagtttgttttcttgcaacttgacggtcccatctgtgggtgatgggaaacaatgacagatcatcaagcattagattttcataaggagtgtgcaacctagatccctctcatgtgcagttcgctatagggttcctgctcctctgagcatctaatgctgccactgatctgacagaagtggggctcaggtggtaatgcgagtgatggggagcagctgtaaatacagctgaagcttcacttgctcacctcctgctgtgtggcctggttcctaacagatcatggaccagtattgtctgtggcccaggagttggagacccctgtcctagagtacacagtgaaaaagtttgatagagaggggaacagtggaagattttgttagatatgtcacatgattaatggatgactaaagttttgtttggtgatctaggatgatagagatgttgagacatgaaattagttggcttcaagttctaagctgtcctgtgtgagaaattgcctcatcagccaacacaggctttgacatatgggtagcttcgtgtttcttaggatacttgggctggtcagaaagtgccaagcatcagagaaactgagacctcggtataggtggaggaagtctaatgatagccacagtcagtagcctagtctgatttgtttttagcaaatctagactattttcttaatcagtaactacttctttagtaactacttacaaggcgactgcctttgccaaggtatatgttctctgaaagctgattcttcatagatcactaactgtagttttgaggttctgtgatttccttcaaaattcacagaaccttgagctataatttatgtggatagagtgattactgggatttaacttaaaattagatgtattcaaatgttttaaggaatatgttttgtaaaacaacatgtttttcattcgttacttatatattgatcccagaaattgtgtgcctgcaaattgtcaagttgggttgatgcttcagaaaaggaaagtagaggctgagtcttcttagtatagcaatgcattttttagagcagtgtttgaggcaaattattttcgcaaaattacatggcttctagggattagattgcatgagtttgtctcttgttcctccctcattctactgtaagaggccaggctgctagttaacagaatgccagacataatgcctagggcatagtttgagacctgggaagattcacaataatcaaacacaaacagacagagtagcatgaagaaatttcaatcctcccagtcttgcttacagatttaattaggcttattggggcagaaaatatttttcctccccccatgtttaaatctgtttctcctctactcccacctcctgtcccagattctctttgaaggggtaatactagcaacaaaaggagatttttttttttttttttgtaaatcctaacttatttggtttatctggctttaggaaaaggagcagtaacaacaaccgaattttaaggtatttgagggactccattttttggcactgtatttgggaaattcccaatttaaaaatcatgctgtactcaagaagaaaattagggtttttttgtggctttataattggatcttttttgcaagtatttttaattttatgagaggtatttggcctgttctgctagagaattatcagccaaatccttgctttctttatattatatatattttcctgagtgatattctagggaaatgtatatggatgctgttctctgtctttccattagcagcgcagtgttgggcttcgaatgatgatggtagatgattgggggtgggagaagaggtggggtttcttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtaatctactgcagtctttgttttctgggtcgtgtataaaatggagcaaaatggtagaaaaatagcttcagtgaaagggatgtacctgttaacaggaataaaatagaaaggaaaaggatatttttacattgttcattattatttctcacaacagcttttaggatttttatcatgttttaaaaaacctaatttgacctaaggaagaaaattcctagttttgaaaacccgtgccttaattgcttagctttagaacaaaggtttttacatccagcattgcaaggatatctttattcaaaagaataggatgcagcattcttatgttacctttttagaactgaattggcataacctctcttgaatcttagagactttgacgtattattctgtgaattgtgatttaattatctcatgcttcaggatggttgtttccctttgatacccaagagaccatggatgggatatagggggtggggattaatattacagtgggggaagggagtgtttttacagagtaaccttcctgtttttgcattggaaactaaattgaaatatataatcattggaaaaggtggtatccatggcaccaatcttatcaacttgaattattttatcctttgttcagtttgtggtatttttgctcttgtcagctgaaatgttgattataaatttgaagaagctgccgagttgctgtgatggcactggaattgcattctgctttctttttctttccaattatagctgtaaatacaggaaccaagggatgaatgtgaaaagaagtaatataaaatgctgaagatatttttggttttctcttgaaagtatttttcatagtgagaattattttcttgtggacagaaagagctaggaccctaatttatgacattaaaaagcatttaagtgctacagacttctctatttaggaaagacagactgaaaacatgttgaagcgtactatggagctttcagttaagttgattatttccatcatggtgatatgagttatcatactgtttgccacattttgaaagctgtttgactcctcagaagtattaacaaattaacaaattcttactgagcatttacattatgctaggttctttagatgtatatcaggtttatagtctagtaaaggatataaaaaactcatgcatatgatgtaccatttttggtgcaagcatataagtattgcagtgttatatatttatgtactgacatgtaggtgttttacataagctactacatttaatcctcataacaacctagtcacgaaattattgtcattcttgttatcctatgcacattagtccaaacaagcaaacaaaaattgtcattctcttttatagatgagaaaatttacattttgagagattaagtgatttaccataagtaacaaagccatgaagtgatgaagcctgggtcagtcagactctaaagctctttccactgtttgtatatgagtagattaaagcattttatcatgattatttgacatcacaaatagtgatgccatgagtgaaaaggagatagggatcctaatctttaatctatgccaagaactgagtgattgagcaaatcatttaacatcgtctgtaaagtgtgagggttggactaggcaaccttggttcatgattctattcagtgtaagagattttcacatatggtctatggaaacaattctcattactttagtgtttttattatatttagtttccattactcatccttcataatgtgctgtacatgttggattgtgtgtggtggggggggagggtgatagagtgcatatcatcttctaacatattacatacaatatacatttatttattaagattattactgtctgtcatcttccttcttcccttcccccaaatatgtcacgaggacctagactagagcctggctacatagtatgcagttataaactaattttttgaatgaatgaataggaataatagacttgtatagtacattggcaaaatatataagtaacttcataattcttaacaccaaaagattccctgggggccaaaattattaatctttctattacagtgatcctttaaggaactaagtgtaagaatcttaaaaagaagaacacctacgaaacaatcaagtgtagtcaagtaatctgaagtttgctggaattcccccatacaaaattattggtagtatagaacttgctaaccataggtttgtttacccagtgttctatttgaaagtagtttactaaagcattccatataagcaaagaaaaaaagcagcaaagtttcttttttgtttatgtgtcactgtatagtctcaaatgctgtaaatttacagtgagtagaaaatattcagaccattgagtcttttgcttaaaagatatttcgtaaggtataacataacgtttactggtagttttgtttcatttaaacattaggcttcttgagagttttaacagttttattgaaatgtaattggtgtataataaactgcctatggttagagtataatttgataggttttgatgtatatacacgattaggaaactatcaccacaattgagaaaataaacatattcaccccaaaggtttccttgtgcattttcataatttctccgtccctccacccctcctcacctatccccaggtgtacccattgacttgtctttggtccttatagagtagtttgaattttcttgctttctttcttgtcattatagattaatttgcatgtctttttgtaagtgaactcacatagtttgtgcttttcttatgtggtctcttttactctgcataattattttgagatttgtctgtattcctgtgtatcagtagttcatttctttttattgctgaatgatatcccattgtgtggatataccacagtttatccattcagctgttgatgggcatttgggttgtttcaagttttagactattaggaataagtttgctttggacattcatgtacaagtttttgtgtgtacataagctttcatctcttaggtaaacacccaggagtggaatggctggattatatggtaggtatatattttaactctttaagaaattgccagactgtttttccaggtgactgtattgtgttacattcccattagcaacattccagttgctgcacaacttcattaatagttggttttgtcagtctttttaattttagccattttactgtgtgtgtgatggtatcatattgtagtttttatttgcatttcatctgatgactaaaaatgtttaacatattttcatgtgcctgttttatcatccatacttcttttgtggattgtctgttcaaatcttgtttttaattgagcttttaattattgggttgtaagagttccttatatgtttgggatataagtgcttttattttttttttattttattttattttgcgacagagttttgctcttgtttcccaggctggagttcaatggtgcaatcttggctcactacagcctcctcctcctgagttcaagcgattctcctgcctcagcctcccaagtagctgggattacaggtggccaccaccatgcctggctaatttatttctagttttagttttagtagagatggagtttcatcatgttagccaggctggtttcgaactcctgacctcaagtaatctgcctgcctcagcctcccaaggtgctaggattacaggcatgagccaccatgcccggccataagtccttttaggtatatgatttagaaatactttctcccagcctgtggcttgtattttcattttttagcatcctctttctctctttaatacttttattgagatataattcacatttccttgagcaaaagttttaaagtttgaattctaatttatcattttttctttcgtagattgtgcttttgctatatctaagaaatatttgcctaacccaaggtcacacctctttgcttctagttttatagttttgggttttacttttaggtctgtgatacattttcaggtagtcttttatttttaatttttgtgggtacctagtaagtgtatgtatttatggattacatcagatattttgatataggcatgcaatgtgtaataatcacatcagggtggatggggtatctttcatctcaagcatttatcttttgtgttacaaacaatccagttgtactcttttagttatttttaatgtacagttaaactattttttactataatcaccctccactacccttcccagcctctgataatcatccttctactttctgtctccatgagttcagttgttttaatttttagcttccacaaatgagtgagaacatgtgaagtttgtctttctgttgctggcttatttcacttaccataatgacgtccatttccatccatcttgttgcaaatgacaggaactcattcttttttatggctaaatagtactccattgtgtatatgtaccacattttctttatccatttgtttgttgatagatacttaggttgcttccaaatcttggctattgtgaataatgctgcaaaaaacatgggagtgcagataacccttcgatatccaggagtgtcctaaatctaaggatgtgtcatattattttttctttatttttttctcctcctgctgttccgggtctctacagtgtcccctactcctttgttttattcgcacacctgggtagtgcctttccaatcaaaggatagttgggtctgcatttcaggtctgtgatctttatgtttagggaaatccgtttcctggtcaaagcctaccagacttccttggtatcactccagaatttaacagatttggcaagtatgttttttagttaatggtttgagatcataatcatttccttcatgctcctcctgccttctatttttgcttttaatattgaggaatgctaatggaatagatttgcttttgctctctcccatctttacctggaattgaacacatatttattgaaggaatgagtggtttgcaggaatgttgccattcaggtggagacatgtttctctttaaatatatagctggcaagttgcccatatggcacatagatattaactgaattatccactgagctctgggattaggagatacagattgtgtaggattgggagttctttctattggcttatcttttcctaaaactatgtaacgggatatgaatacctttctacctaagtatcttgtcattatactagatctagttttctgagtctcacttgtgaaagcttttggttaactattaataaaaaactgtacaaagggaagatgataatggtttctcttgtaaggtggtagtccaggggttgaaagcaagggttctagttagactgtgaggttttgaatctaagctccctcttctactagttatataacttgtatatgttacttaacttctcagaacctcacatttctcttcaataaaacaaggctaaacattttacttatagaattattgttaaaattaaatgaattaatgcataaaaagtacttaaagcagatactgtaagtatgcaagtaaagctactcaagttttagctattattgtaaccattttaattgttaattattgttcttatagataatggatgatgtgtttgaagctatcacctagcacaatttctgactaccaaatgtagtttgaggcttttgagtgtttttcacctaaccattcttcccaaatgaatatttttcagggaagctaaccccaggaaatgtgacacaatttactgtattgttccttacctctataatgtatgtttattctagctggttcatctcttccttatatacaagttccacagaatgatttttttctaataagaattaagaaacctttgttctgatgatgagcttatttaaatttgggtttaatttgatagaaaattaagctgtttccttaatggggaatctggccaatcaccatcctccaccctcccagggtagaattttttccaggaattaaatagctctatctagcagggtcttcctgcctttggcagtagagcagtacaaaggccacattgagcatagctgctggggaaaccctttttccttctctagcctataaatgctgttctgtctctgtgaaaagccctgacatcagctcttggaaaaatccaaatacttgtgttagaacaaggctgaaacacttgcctgggcagagactaatggctgaactatagttctaagtttaccagattgcctctcagtattgttatgctttaaaaaacaaaacaaaaactgtaagtttcagacataatctagagaaattaggatagaaaggacaacttaatagcgcctcccattctttgctagtttcttcttatttttctcttttttctaaaaatctaccttcaagataatgtgaaattcttgcttgaggagtgagggagagaaataatatatcaatattataaactttatgcagtgttttccacatattagatgctgcataagtatttgatgtttgagacaaaataaactgtaaacagactgtacttaacttccttagtgttcaaattagatcatgatgtaaaactctccagtggttttccattatattatgaataaactctaagcctgtttctgtggctcacattcttacattagctggcccctgtctacttctgtggatctcatttcagcactactttactactctcttggtcattttctatgcttaagccacagcggactttgtatttctcaaatacattaatctgcttatcctttgtgactcttgtactagctgtttcctttacctgtaattctgtggcccacatcttcccatggctggctccttcatttaagtctcagcttaaatgcctctaaggtcttttttgaataaactaaattaatgtatttagtcaaataatatctttttttaatagcacttaccacgatttgaaattctttggtacaattatttttttgtggagtttatcttcctcctgtggaatgtaagctgcttgagagcaaggaccttatctgttcattaacgtaacctccagtgtcttgaacctcctggcataggttggtgtttgtgtaactttgtatgtacttggctgcctgtaacggaaaacacaagtcaaactgacttaagcagtaacgcatttactggctcacataaaaaagaaatctagacgtaggcttcagagatttttgatttagggacgtaactatgtcaagggctcagatgctttccatctttacactcttgccatcaaaatcatcctcatcctaaactagtccttaaagatgaatgcgaagtagctgttaaggctgcttgcttcttcactcaggttcagtgggagggagagaaagaagtttcacatcattctctcaagaataaggaaatactttcatagatgccaccagtgaactttgtttctacttttattggcttttttggaaccaattgcttacccaagaatggaattactgttaggccaaaaaggcccatcactgttgctacagatggggttggcttgacctgagtcatctggactctgagaggaatagtagataactgaataaaatcggagttctcttaaaaggaaggctgtggtttctggggtaacttatatcctctgtagttctcaataaaaatgtatggaatgagtgaattcatgtagtaaaaatgtattgaattgtcaggcgtatgctcagcaccataatagttaagtagaatacaaaatcaaatagaatgtggtccttgccttcaaataatttaaaatctagtgagagagccaaattaacggaatattaaaattgttttaaaaatcagttgattaaaataatttaaaagatgaaaaagagaaaagggaaacaacagatgagacaaatagcaagatgatagacttaaatacattagtaatcacactaaaggtaaatggtccaaacaccccaattaaatgtatagactatcagattagatgaaacagcaaagcccaactgtatgctacaagaaacacaccttaaaattaaaaatacacattgtttaaaagtaaaaggatggaagaagatgtgccctgctaatctacattaaaggaaaactagaccacattaatatcagataaagtagatttaagattatagaatatcaacagggataaaaaaagtaatttcgtactgataaaagggtcaatttaaaaagaagacatatctaggcatgtatacacctaatgacaaaacatcaaaattcatgtaacaaaagctgacataactgaaaggacaaatagacaaatctacaaacattgtcagttatttcagtatccgtttttcagtaattgatcaaagtagataaagtaagcaaggatatagagtacttaaacaatactgttggccagtttgatttaattacatttttggaacattccagccaacaaccaaatactttttttttttttcatgtttgcaagcagacatgggacatttaccatgacagacacaattctgggctgtgaagtaaatttcaataaattaaaaggattcaagtcatacaaagtatgtttcctggtcaccatggactgaaattagaaatcaataaaagatctctggaaagtttccaaatattggaaaataacacaattcttagtcaaagtggaaataaaaaaggaaatggcaaagtattttgtattggatgaaaatgaaaacacaacatatcagaatttgttggttgccattaaagcattacataaaaacttatagcattaaacacctattagaaaagagagaaggtctaaaatcaatgacatcagcttcttttttttttttaagacagggtcttactctgttgcccaggctcaagggcagtggtttgatcactacagcctcaacctcctgggctcaggctgtccccaccttatcctcccaagtagctgggactacaggtgtgccccactaattttttttagtagagatggggtctcactgtgttgcccagactggtctcaaactcctgggttcaagcaatcctcctgcctcggcctcccaaagtactgggatttcaggtgtgagccaccgtacctgaccaatttcattttaagcaactagaaaaagaagagcaaattaaaaccaaagcaagcagaagaaaaaaaaaatagagatgaaagcaggaatcactgaagcagaaaacaggaaaacagtagcgaacattaaccccaaatctggttcttttgagaaaattaataaaattattaaacctctagccagctgatcaggatgaaaagagagaagacacacattactaatatcataaatgaaagaggtgacatcattacagattcttcagatattaaaaaaaaataggggaggctgggtgctgtggctcacgcctgtaatcccagcactttgggaagccgaggtgggcagatcacttgaggcaaggagttcaagaccagcctggccaacatggtgagaccccatctttactaaaaatacaaacatcagccggcattgtggcgcgaacctgtaatcccagctacctgggaggctgagggatgagaatcgcttgagcccaggaggtagaggttgcaatgagctgagatggtgccactacacaccatcctgcccaacagagcaagactctatctcaaaaaaaaaaaaaaaaaaaaaaaagataagggagcattatgaatagctttatggcaataaatttaacaatttagatggaatgtggttggtaattttataaattccaacaatatatatacaatatgtaaatatatattacatatacataaaacaggaaaatacataaaatatatatgcactctgtgtgtatgtatgtgtgtgtaatgaccgggtagggtttatcccaggagtgcaagattggttcaccttacaaaaatcaggcaatgtaagtaaatggatggtaaatggtggtaactatgtttctcactgtctcaaaggagctaagcaagagagaagactggaatgaacctgatggaattagattagaattagagatatcagtatgaactcatgctgagcttaatatagatacagatatatggatagctacagaaagaattatagatatgttgtattagtctcttctcacactgctaatgaagacatatccgagactgggtaatttataaaggaaagaggtttaattgactcacagttccacatggcttgggaggcctcacaatcatggcagaaggcaagtgaggagcaaagtcatgtcttacatggtagcaggcaaggagagctcgtgcaggggaactcccctttatataaccatcagatctggtgagacttattcaatatcccaagaacagcatgggaaaagacccccccccttcatgattcaattacctcccaccaggtccctcccacacatgggaattatgggagctacaattcaagatgagatttgggtggggacacagccaaaccatatcatgtgtatgtataccccagttagtataacacattcatttccctgctctctctgctgagagggcctagaaatggtgacatctcagtagcagtgagcgcacccagctcctggatcttggttactaaatatcactctccaataaaatagctccttggagaaatggttgactctaaggctgcaatagggaaaatgcaagttgaacctagagtgccttatagtgccacaaacaagaaagtgcccaaacagaagggtgagagcatgtcagtggcataaacgggaagaatttgagcaagagaataaataacgtagtattggattagaactcaaagtctaaaataaacatacatgagcccatactgataaaaatgattacataaatacatgggtgagaaaacacaaatcttccttacaggaaaatttcaaatagtatacgtagattcctattcccaggagatggagcttaatcctctcagatgctagtgtggattgggcttagtgacttcttcaaagaaaaaaatatggcaagggaaaaataataactttacagggagacgtcgagcaaccactcccttaaccaaatgaccaaagttaacattactagtgttaagtcatattggtgtcatatatcctctgatgggtgatgaaaagggtacttcacccctgtggtattccaaaaatagacccacgtatatatggaaaactgattttcaaaagtgcaaaaggcaattcagtttcaacaaacggtgctggaacaattggatttcaattggatatcacactctatataaaaattattacaaaatatattgtagacctaaaagtaaaatagaaagtcactcagctcttagaagaaaatgtaggggtaaatctttgtgatttggggttaggcaaagatttcttaggtatgataccataaacatgggcagtgacctaatttccaaataaagtcccacaggtatggaagttaagacttcagcatgtctttggagataacacaattcaacctgcaacaaatataatggttcccaattaggactgctttcatgtttaatacagagaaactgagaatctctatatgagtttagtgcttttcacatactacctaagaaatgcatcttccacatttacatttagtcttccaatgtgttggtgttgtcattaacaaaatacaaattctcctaaaaatattatgaattgtagctttgggcatttattcagtttgtggatagtataataattgctattatgtgtatccctgggttttgtttgtgtgtttgttttctactttcaacacaaatagggagagagtctctctcaccgatttcgtgccacactttgtcacttgggcattaaaataattttaccctggccctttgtcttacaaggtctgttgccaaaacaagcttcttcagcttctgctgctgtttccataaagatttgacatgagttcatggaattgatctcggggacgagtgtgtcctctcttttctgtttacctagtacccacagaaactcctgtcatttctagtccaaactcccacctggattccttactataaatgaattcatcccaaggaagaaatcaagggggagtatagaacttgggttacaaggatatttgttataacattctttattatgctgaaaaattagacccagcctaaatatttacaaaagggaacttcttaattaaatagccatatcacaggatactttgcagttatcaagaattatttagaactatgttttttaaatctttatctgatttggaagttcaatatatagaatgaataaaaaacaaagcagctctgatatgtgggaagtctagagccccatctacacactcccgctctgtgagggacctcttttaaacctctagaattttatagagcacagtttaaaaccagcactgtagtgaaatatttaatatgtaaacatatgttgatattttatgaagttaaagttgtcaatatgtccagtatgctttaatttttatgaaaataaattttaaacattgtatacagaaatctatctctattttgggaaagaatgggaatatatgcataacaatgctgggtgttgggattatgggtgatttttgtttactattttgtctttagtttttaaaagtttatacgtgtacttctttggacataaagaaagtgagacatttcttcatattgaaaaggcagagagaaccattgctttataggaaactacagtttggaaaaacggcagtctcattactcaatcccttgagagaggaattatcttgaaaatgttataaaaaatattagtaacagatttactagtgtcagtggtcttgtgtgttaagtatattaggataagccacatttgtaacagctaacggagaaaacataactgaatgtcagtgttacacagtgaactttgtagagcagtgattcccaattctgagatgttgtaagaggaatgtcagaattcctaaaacactcatcctccaacctttcaaattcagtgctgtggtgagccattgttactgataagggtatatcccacttgtgatttctttgttttgggtcaagaaaagcttttgtagaagccagtgtaaaatggcatgcatataattaatttcctcatcttttcctcataaaatcagaggtccttttatcgatggtggtttgaaagtctggggtattcagatttggcagcagaaagtgtgttttttttgtgtgtgtgtgataaactaggtggattgctaattctgattgaggaattcgtaatgtttgacaccagaaccagagcacttgtgaaaagaagtctctttagtacaaaaccaaaaatttaattacagcatttgttataactatagccaataaaagtatttttaatgaaaaagaatttccgcagaagaaaatgctttctattaatgcagaaggtgttatatagaagatttaattgtaatgatattggttatgatccgttttttgttttatctttacctgtattttatattcgtataacctctaaattttacaaattacccataatacatttcttatataattaaaaaaattctgagtacagaacaggaaatatgttcaatctttattccattagagttctacttggaaagtattaatatgtaaggtttttatttctccataagaaatagacctatatagtcaggcacagtgtctcatgcctgtaatcccagtgctttgggaggctgaggcttgaggattgcttgaggccaggagtttgagaccaacctgggcaacacagcaagacctggtctctacaaaaaaattcttaaaaaatttagctgggtgtggtggcatgctcctgtggtcctacctacttaggaggctaaggtaggaggattcccttgagcccaggagttcgaggttacagtgacctatgattgtgccactgcactccagcctgagtgagagagtgagacattgtctccaaaaaaaaaaaaaaaaaaaaaaaaaaaaaagaaaagaaagataaatagatctatgtctagttaattcgaggagatggtacacatttttagagcacatgagaacgaagtttatacttttctgattttctgggtttccttgatgattttttggcaaatccttgtctgtttagctgtctggcatatgtatgactgtggttgggcttctttgtactcaaccaatgaatgcataccaactgtaacacctgaaggtaggatcatgaataaatactctgtgatttggggttagtatagttttggttgttttcccttctcctgagatttcagaaataaaagattcctattcctgtgatttttttggcacacagtaagacatatttgatacataagataagtcattataattaacttgtcgaatcactttttcttgctgcagaatgatatttttatgaatgccttaggttttttcaataaaaaatgcaaccaaactgcaaatgtactgtgatttaaagtggtaatgtcagaatttaaattttgagtagtactctttttttaaatcatagaatgctctatgtttattcaaaaaagtaaaatattattagacagtattttttattttaattttgcatttaaataaagttctcaagctcagactgaaaagtaaacactgtatgttggagcctgtctcaacgacacttaaaagctaagactttctactttttcagaagtacatttgtatcttttggcaaatgtgtagaaagcagcctgtcctaacaaattttgttcacctgttctcacttcagtttatagattgttaaacatttaatcataatatattttatatacaatatttatgtgaaaaatgcccatccttgattaaggggatttttttctactcttatttttattatttttaccagtatattctgaagtagagaaatgtgaaatgagatgaagatttaaattcctagcaaacagaatcatgcattgcccctgttttataagtaatgagatcattttgtagagtccagtttatttacatttgttaaatgatattaatatctcttccataagcatgaatttggtggtttgcatggtgttcactgaggtgaggatacttgtttaagtattttgaggatctcatactttcctagcagttctttttacttggttttctgaagtgaatatagtctttaaaaaaaagtataaggtactagtaatcagatactcatgatcacaaatgaaagtggtggagaaaccttttaaggaatattcacaaaagtgataattttccagattgtcaatgaggaaatgaaagtctctaataagctgtcacattaattgtgagctgcatttctcagtcagcaacaactaatagtcaatctataatagctccagcagagggaatgaaagtaatttagaaaaaagtttactatttgatttgtcaaagtgtgtccaggaagtaagagagcctaaccaaggggctgttgtgcatgtaagctcttcagtaaaagtggtggtgtactaagctatatttaagaaggtaatttgagattttatattacatgctagtgaatcatttttggattttgcaccagaactgagctctttggtccctgcctgtctgtggtttgtgttgcaaggtccagaggcttaaaacaaagaacaccatgggaaattctccatgagtcattccgtcagctgtagcttctgttttatagtccttcggatataactagtgttttaatgccagctctcctagccgcttttcatgctttggttctatatgctaataaaaaagtatggcagtatggctattgtagataacgttcagacttttttttctcccgattccacaatttttagttcttctaatggctctaagctagaccaattataaattgtaactggtgaaaagatttatgactgtttattttgttgtagttgcgaggtaagcgagtggtcacttaatacttttggttctgtgaatcttactgtccagagaactaaagattgaattagcagttcagctggagtcagcactatgtgctaaatccctatacttaagagctcttatgtattgcagacaaatgtcctcttagctgttttgttattttgtgaaaaataataataatagagcaaggcagtttagattcatatcagtttcaaattttaagtaccatgttttaagccattctaattgttttgtagaaacagataaattaaaaacttgatttaaatccagcccacaggatgccttaatcacctttgatattttaaaggagatgaggaaataatggacttttttgctagtaagtggcaggtatggtcaacacaatttcactacatttgaaaaaaatcactttccctgcttgccaggaaaatttaaagtgcagattgtaacctgatcttttttcttacagtgtaacgtctgagaagttcaagtattgacatgaattttctatgataccacttggtaaattaaatctgtggtttcatcactggctttgaattatatatttctatgcattttacttagctaaaaacttatttgaatatttagtctttaaatttattttttcttttctgcttatttgaatacatatcaccaacattcagattttatttttgtttttcttaatagtaaatacataagtggttactgcttgctaggcaatgcttcttattttctaatttaatccccaaaacaaatttgtgaggtataggtagatgtattagtaattatgttttagaggagatgcttaaagaggttaagcaacttgttcaagttcaaatacctgttaaattatgaaactagaatattaacccagttacatttgtttctgaggagtcttttgcccccaaggccttgaaattttagggaattttcatttatagcaatcaataatactattcccatcccaccctgtccatttctgattttcaatagtatagtttctgcactgatatttacatcgtcttacgatggttgagccttaaaattacctgcattgttgtctgatttgcaattctttgtctagtaactcttctcactggagtgggttccaataaaatggtgctgtatttcactcaaaatcaagttgcagtgttttttcctcctcattttaacatcactaaaatcagagtgtatctactaatggaattcttgataattctaaatttaataggtaacattctttgactgctaataaaatcttaaccactatccaatgtaagaaaaatttgtttaaccatctccccttcatttcaaccattccttattaagaagaaccaactacagtctcaaatgctcctttataactaagcccagggaagacatatctaacaccctagaggagagagaaaagggtatgaattaaggtttgagtgtgatatcagcatttcttctcatatggcttcagaacacttctcactgaagtattgtcaaaaggctctttatgcactgaaatcaataaaagaaaaaaacaatttctagcaggctatttattataagcaaatatgtgacgacacaaaactttctggtcctttgcaattttttaagtccaaaagaaattctgtttaacaatattaaaggactattccagttacaaaattgtgtgtttgtgtatgcttattagaataattaaacttggttaaaatgtaagtcttactctagtatacattatttattgggtaagtgttatttaactaccaaatcacatttccctctacactgtaataacacatcgggaagggccacctagggctttaaaattagaactcagaatttaacaaggaaaaggtattctgagttgagtgaataaatgtattctgaacgtttaaggcctttggttaagatttctaaaatgtagctgtgcttaatatacaaaatcaaaagtaaaggcaggccaggcgcggcggctcacacctgtaatcccagcactttgggaggccaaggcaggctgatcacttgaggtcgggagttcaagatcagcctggccaacatggcgaaaccccgtctctactaaaaatacaaaaattagctgggcatggtggcacgcagctgtaaccccagctactcgggaggctgaggcaggagaagtgtttgaacccgggaggtggaggttacagtgagctgagatttcaccactgcactccagcctgggtgacaaagcgagacttaatcgaaaaaagaaaaggaaaaaaaaaaaaggcatctagccaccatatcccagtgattcaaattcctgataattctttgctttattaatcatcgttcttcattttggaatttgacttttttgctatctgttaatagaaaaatacacacacacacatataagtaaacacagtatattcattgttgaccaagtgtccaagttatcaatatgatattttcaaaaaccaggcacagtttcattaggcacctgtaacattatgtcatagtcacatacagctgttctacataatatcgatccaaaagatattgtcatgatttcatgattagactacacagtggacagggacttaaaaatataggagttttgttcaccagaatgtatttcatcagactaatggttgaactgatttgttgcttatgacctggccactttgtagctttcagacctgcctttctgtagcagttgatagtatggattatctgatcttccttcccttctgggacaggcttttctcttttctaattcattttcttaatctcctacctccattctcaatcatgcagatgctagtttctcccccatatttgagcctgagcattttttcaagtttccttggtgttttacatttcagtgaccatcagtaggttgataactcaaatctgcaactttagccccaggctttctttgaggttctagctttctatttccagctctctgattacatctgtctcaatattcagcatgtggtagggattttgcaaaactatgggattatcttggtgactttcctagctgaagcagagagaactaatgaaatagccaagaaggttcttgacattgttacttatgcatataagcatatatatacacacatatgtacacatatatttatttgctttagcagatactttaaagtagaattcaatgattagagaaaaaattatgattttaatattatttgagacgttcttaatctatacttgaagtagtaagtagattatgataagcaagttggactgtgggcgtggtccttgttcattttctcattccgtttttgtccccatttttcctctcctttttcattaccttgtaagagaaaatagctcaggaaacgggtttacaatcagtagtctgggaacttccgggattctttaccagcatccccctggatgttgcagtccctgacgcaagcagcattgttttagggtaggagtttttataatggctgtgaggtcgagtgcctaaggttgataaatggcagttgttatcctttgcagaaactcagttggaatcctttctgtcaacttgtatgttcatctgtaaattaagaaacatgttcccattccctccctctcctacctcaacagttatggacagactgcttaggaactcctatttctgaagatttcgtggtcttttgtaaagtcagtttgttctctagagcagtgtcatcttgtcccagaaccccctttacttactaccactacttctttgtaagttaacatgctatcactgattaggaaaggttttagattcttagtctttttctatggatcaattttggtttaaataggtgtcgaagggaattgtaagtcagcttgtattttggaggttttgtttctacctccatgccaaatgaaatgtagtcattgaagtatcattgtattatgtttatttctgtctttactaataggcttttttaaaaccctagttttactgatgttcttaataaagtacggttcctattactaaataatctttacataaaatgccataggttgaaataatttaaaagacagaaatcaaaatgtaggatgatatttgagaagacttagattagcatttatatatagcatcaaacgcttatcaagaagcttccggcagtattcatttaaaagagagagaaccaggaggaaatgctgtagttctttcagcttataggacccccccagaaaaacaaaacaggaaagtgccctttgttttctacttttggaaggtattttttgtaaccgataattactttaatgttaatttttttctagataatctgttattaaatctaaacctaataattgaggatcacgatgacatagatcaatagtgcagtaatcaacacccagatattttgggaagtagtgtgaagtgatgggaaggaaggaactttcccttctaggaaaacagtgagaataatattttaatggcaaaatatttctttttgtcttgatttttaaaaatctataaaatggaaagtatatctcttcatagagatttctttttttcaagattaaacgagataatacatgtggaaataatgcatagcatttggtaagccctttataaatttagcaattgctcttattattgggatttttaaaaagaaaagctatattctaggacagctgatggtaaatgcactggcagtttaagatttaacaaagtagttaagatacttaaacatggtgttcaacttcttattcctccagcttattgattcttgctattggaaagttaccataagatttaaatctcttattctggttcagtaggatgaataaatttagtaacaaaatcttacaagtaaagtaactacatctatccttattttttctttgtttcaggtttcccctcaaaaaacctataaggtaagtttgctcaattacacttcatactcaagtttaggttatattttaattataagcatccctttgaaattatggtggatttttgtggtttttgagaatgtgtattcaagtaattcaaaatttcaaaatgttttacaaatttaaaatgtaaaagatgttactttttctggaagacagcattgttttgataatacttctaatataagcatttaaaaattttgttcaaaaggatatttaaggtcacactgaagagacttaattttgaagtctatttgtgactgttttgaattatgagtagcttaggaggtgaaaatagaatgctagtttttgatgtgttttatcacttgtgtgactataattgcctttagttaatgtactttggtactagtttagtcttaattactttattttttattttattttattttattttttgagatgggatctcactctgttgcccagcctggagtgcagtggcgcgatctcagctcactgcaagcaccgcctcccgggttcacaccattctcctgcctcagcctcccgagtagctgggactacaggcgcccgccaccacgcctggctaattttttgtatttttagtagagacggagtttcactgtgttagccaggatggtctggatctcctgacctcgtgattcgcccgcctcaggctccgaaagtgctgggattacaggcgtaagccactgcacccagcctagtcttaattactttaagacagtgaagaaaaaaatccaaaatgttaaaatgtatctatgcctatatccatgtctatatatttattcatttccaggtcttaaatgcctcttcctcagtatttttgctttcagcatttcttctgttatcttatcataaatattatttaaaatgtaggtagtatgtcattcctaattattatattttatcatttttagtgtcagcatagtccaggatccaatgctaaccttggcatttcagtgaatatgtgtatgtgtacatatgtattattgttatggtcttgtcacccaaccattatctgatcagtgtaattggctaagccatagaagtaataataataataatgtcattggtccttaaagtggttggctaagacttctgtggctagaactacatcagcaggcttaaaatgaggcttgcctaaggctgctttttaaatgttaaaccgttctcatgcatgctctatttatgcagtgattttgaacttgatcatagtatatgtagagttggagaatgggtttaattccttttaggcactgtgttttttttgtctgttaaatggaaatgatagtattgacctgtgaaaaccacacaaaaaaaatgtaagcagttacttctgagaataaaagagactttaatgctgaatactatttttaattattttaagcagtttttataatcaagtaaatagactgtgtataaccaaaacttattgaaaaatgtaaattagagaggcttatggtgctgtgtaaagtaaactgatttcctggtttttcttgtaagatccacttttagaattttaaattttttattctaatgattttcttgcactaagcatttgattactttgctttaatttaggcatggaagtattttgaaccgagagtcaccaacagataagaagcagaaagttgagcgcattgcatcacatgattttgaccccacaggtaaaacactattcattctttcaaagagtattgagagtagtgaagttcagaataatagagcttaagctacccgaaacactcaggaatagttgtttgatctgttttaggactctcacattcctccaattatatcataataaagcctttgcatttagtaggaatgcaagcatttttaacttccaacactgtacattccactacagaagtatcattgtagagtatattgtatctttaaatagtgataataatagaaatggttatataataattggagatttggtcagatcaagaactcagtgttaagttgaatcatggtataagcagtaatatgtcataaaaccaaggctctaacaactcgacacttgcgtagtcatctaaaaattcaattgtgattatggtgaattggagttttagataaatcagtttcacaaattaatgatggtctcattttagagtaaacaaatgaatagaaatccctttctcttcagtcaaaaagtattctgaacttaaagagctgtctttcaacctaagcagtgtcgatctttcctagggttgtcaccttaacagactttcagattgatctccttttaaaacatctaggctttttccttttgctttctccttgtaagcttactccatatttgattcatagaaagtgcttggtaatcttgcttttttcatttgaaactgatatatattttttgtgcacatactattttattcagttgcctgtccctttgacaagagacgaagtaaatcccgctatctcagatacataaaaataatgtatctatttttaggtatttttacttagaaatataattttaaatatttaatagagaatagtatgttttatttatctaagacatttcatactttattagtataaactcctttattttgaaaaaatattataaatattatctaggaagcacatagataatcattttctgcattttgggtagtaggtaaaatgaaattccaatcatcaatttaggaggctttggtggtgggactatgtattatgtcacttacagatctccatgaagagagaattttccattctgatgcctaattttgtagtcatggggctcagaggctttcatttacatgattaggtattgtcttgccaataaggtcaaaagtttctgccctatgttcagaaaaatataatcttgttaggtttattttgtatctacatctgtgctgtgcccatctccaaagacagatttaagcaaagatgtatacaatgcttcataatgagatcattatagcttttagtgcttttgtcatctctacaattatcaggtgatatattttgtatactattcatgtgttgttttgtttgaacatatttttattgcactgtcttttcttcgataaatctttaaaatatgtcattacctgtgctgtttgtgactattctaagtgctgtcatctgttatgttcatactttgtgtttgcacgatttaacttgatcatgattcattcttttttccccatgaatttttccccttacattgtctccatattttctatatctctctccttttctcccgctcttgtgcagatagctcctccaagaagacaaagtctagttcagaggagagtagatccgagatatatggtaagctaatgtagctaattcagccttgccctttggagcttgcttcatggtgttccttttctgttctttttttcctttctttctttctttttaaataactgcagcctttcttgtgtctgctgtgcatggcatgatctactgcagggaaagggagcctggggttttaacgtggctgtgatgtggaagcttaaggttgctagaaactaacattgtagattaagagtaggccacattgcccatcttctcccgtcttgtttatggtaggaaggtgattatctctaatatgtttgggtcaggttcctccaaataacatgaatgggctttgaattcttgtcatcttcttcccacatctcatttgcagagtttggattatgaagaatttgaggaattaagtcttttcctctaagtataatactggtgtaatttagacgtattagcagttctttggaatttttatttcattttttgtttgtttatttttaattgcctcgtcatgtggaaaagtcattcttgtataatttatccacgatggcaaaaatacgtaagtattttatcttcatagcttgaagaatttgtgcctttgagaagtttctctgaagcttaatcggaatgggaaaatttcagaatggtaccttttaaataatcttaacaaagagcaagtttaacctgagtggtcaacttttgcagcagatgattgaaatgctaatatttctagactgtgtcctgtcttccaaagatacaataaccatgtttgtgaagttcatacctatttttccttttcctttgcagttttatttgccctctttccttcttttggagtctgattagggttttgttttggggtttttttttttttggttttttgttttttgagaaaagtgaataagagaggaattacctggagctaagattttaaaaataatttctgaaagactgataaattatttctttttttaggaagattccaaatttggcctcgaagggaaatcaggtcatctttaatagagccacaaatctatagagcagaagctcccccaggtgcagatagatgtttcctagcttgatatataggagaggaaaaaatacaggaattgccctcccctttttaagacatttgataattcacatctgctggcacttgagcccatatcagatactttttagtattatgaaagctcagtgtttggttctaaaccagttaattcttctatgttagatatatacacatagttctttacttgggtttttgtgaccagtgctttttctgtgtataccttttacagtagttcagcagtaaatgtatactgtgccttgtgacacatcaagtttacgctttttcttccttccagagtattttggctactgataagtaagaactacctaattcctggagactatatttctgttctatataaagagctttctatagtttatcctctccttaggaacatgaacattatctttatagctctattctttttcggtagcctttgcagtgttctatttcgtcttcctctccattttcctagatctgcgatgtgtatttagaagcttgttgtatgctttggatgaagactaacaatttaggaacctctgactagaaatactatactaatatttttcttagcagtgatagaaacattaatactagttcaggcatgccattggcttggtagtgatagaaacattttaagtggtaattgggaagtaaggtgtggcttctctgtgtgtttgttttttgagaacccttgaaataccttttttggaaggaactgagtccacaagtcctcaaaaagcactcatcggagggatgagttgattagaacagaattagcatgctaacgtaaatctctttgacattacaaatattttatcacctgtgtgaatagacgtctttagattacgtacagttagcatagatgaaaaagtctctctggggattcagaaaagcttgaaactactgagtagaatcatagcaactggtgacattctgctttagtgtagggtcttattataagcccacttcaaactttagagattatacattgctttctcggggtaaaattcattagctgagtacttaacaaaaatgctagttactcacatattatttattttaaactttcttggcttttttttttttttttttttttttttgagacaagatctcgctgtgtggcccaggatggagtataatggcgggatcatgactcactgcagcctcaacctcctgggctcaagtgatcctcctacctaagactccaaagtagctgggactacaggtgcacaccactgcacccagctgttttgtttgtttgtttgtttttttaatagagatgaggttgttgaaggaatgatttgccaggggaaaaaaaaaaaagaaagaaatagtagagacaaagtctcgccatgttgcccaggctgatctctgtctcctgagctcaagcagtcctcccaaaatgctgggattaaaggcataagccaccgcacctggcttcttagccatttttagagctactttgtgaactagatttactttgtgcatcttaaaaggaaaccaagtgtttgctttgtattgactttttttgttacatttctgcccagtgcggtcagttggttatttattccatttccccttatttgtccctttctacctgttagagtctattaaacgtgtatggatgcgttttctgatctacaattttaataatacttaattttattaatacttttgtgggttactgtaggaaatgagagattcagcaagggaattctgagttagaccatagctgctgcttaaccgctgtcatggtgtctgaacagattcctgctaacagtatttggttcaagaaaataagttatgtctttttaaagctgtcttagtgtgttcaggccactgtaacaaaataccatagactgcttggtttaagcaatagaaacttattttctcacagttctggaggttagaagatcaagatcaggatgtcagtgtgatcaggtcagaagattcccttgctggcttgcagatggctgccttcttgctgtttgtctcacatggcctttcctccgtgtttgccaatgccctttctttagtttctatgatattacatcaacctggttctttattctttgtaattattttgtctctctttatttgattgttttttccctcctgttttatacatgtaggcatgacccaagtttctgtccccaatctttcttccagtctccagtctaagtgtcccataaattcagagtgaccaaactggagttcatcattgttctctacagctggaaatcagtcttcctctttatttccctaattcttataatgacactgtcatttttccactcacctagtcttatatttccttaaagttatatttgacttctccattttccgtcgtcccctgtggtcagctatttgccaggtccccttgattctaccatcacaatatttttcatccttcactctttggtttcaaccccactgccttgtccatcattttattagactattataatagattcgtaacttacttttatttcagtttcacattgattcattaacttttctccattctatattctgccttgacttgtcagattaatattactaaagtaagaatttggtcattcacttgctaagaaagtacaggtagttattaagataatgccacaatttgtttccaatttattctactctgattctccttcagcgtttcattttccaaaacatgttttggcattcttcctttgcacatgccatttctgttgtcttgagtgaattaccacctataacttagaatcctactcatctttcaaggcttaattcaagtactgccttttcctaggattgcccagctacttttgttgtttctgaatgttgacatctgttttgtatttaattacttatatttatgtttatctttacatctcccataatgctgaacatattggagacactcattaagtgagttttgaatgaatgattgttgagattgacataggaagtattttagtagagaaaattgatggaataagatcttcactcatcctaattgaatctttctttccttctgaaaaacttgaagatagaagaaaatgtaacttggagacatttttctggtagtggtctgaaagaatgaaatcagcatacttggaatttaaggctcttcttgctggcaagactgtgcatttagaatcaagaagcttcttaatcaaaggattatctgaggtcttactcataaaacatgtatgtctggcaccagtttaaaatgagctgtttttatgaggttgcacatggcccttctccactcccttccctgaagctgattcttaagagctgaaacctagagaagtttggtcatgaaataaaataaaaggtgaagaaagactaatgtgctttcactaaagtcaatgtaatatggaagatttaacaggttatcttacatgtttaacactccattttcattaatatgccccacaccctattttcattataggagttatggccttctttcaggaacagttatagaatgacacttcatttttttttcactttcaaaatatgatcattggtaattatctattgagtaagaaggaagcagtctttttatgttggttttaagtgccacattgtaataacagaaaaaatatgtcttttgttatgataaggaaataaaagaaatggatagtatttatgtaaatttgatataacatctttacttcactgatgagatgaagcatgatatcaggtttatcagcttctaggcaaaatatgatttttaagagacaggaaataaagtttgttttgtaactagaggagttattttggggtagatggaaaaatcaaattattatagttggaattttgccagggcagaaggttaattagcgttcttatagaaatgttcctctactttgcatagtcttcaaggctgtgattttttttctaattagaaaatgtttgagtattttatttaaaatttcctttgtgtataaaattcaaatttatttaataactatttagtgagcacccattacatgccaggcactatactaaggcatagagatacaaagatataagtgactctacctactttctggttgttcacagtctggtacaaaagaattgcaatacattttgataagtgcagtgatagagatatgcactcatttaccattactctatatgcacttaaaaaaacagctgtgaagaaatactcatatggcaccaagaacaatgggacggaagaagtattactaggactaagtcttttgtttttttgaaaaacgtgtttattattactgttattttttgtagagaagaggtcttgctaagttgcccaggctgtgctcaaactcctggcctcaaccagtcctcttgccttggcctcccaaaacgttgggattacaggtgtgatccacggtgcctgcctgtcaggattacgtttgaaggaagtttaactttttataccagtctcactggttttactttttgaacactctgcctgtgtctatgcaaagtgctggcatatagcacatatcaaagtaattaggtggccttacagaactcatattcacagatagatacatttgtatggaagttatgattaataatctttataccagatgataaaggatttagcaacaaaacaaaaccatggactatatgagttgtagaaatcagaaaaagtaaaagtgatgaaagctggtttttgggtttttttttaattaatgaaatttgaagattgctattttggagttatgagtctacttttatctttggctttctctgtaacatacagggcctattttctgtaccattttctgattcttaaacattgtcatttttttctccatttgttttcagtattgtcctgccaggattttatgttctttgagaacagaaactccaagtagtcttgggttcttcacagcacctatgaactgcagtgttaaataactagtatggacagatgctcaatgcaaatttgctaaaacaaacaaaagaagtaggatttttgtgtgtgtatgtcaaaaaggatagtacaaagatatgataatgtagccagtattggtgattttagttctacagagggtggaatttttccctctgtggtaggttaaaacagcttctggtcaacaaatagaatatttctctgaagaaaaagggaaaacatttcatttgattttgaatgagagggaacataatagatttgagcatttgaaggactggatttctgaattttgaatggtaggatggcttcgttttcagttaattattaccacagatctaaatttatgcagacaccacagatagacaggacagaatagtattgttaatttgaattttatagattctgaattgactgtatgtgtaacactttttatattggtctactgatttaaagtacatgttaaagtacatcaatctcacattagcaggtaaatataaaataataaatgtggctaatacagtggatttggggagaagaaaaaattgaataggatgtgtgcatagttctttttccttttcctctttattctttgtccctcatctccttttgctgtagaattaagagggaaggttatcagactgagactgttatgaattggagataagagatttgctgtattctgaagtaatactaataggttttcttgattcttattaatctgttaggattctaggcatatttataaaattgactgtgcatggtgctgtttttttctctccgatgacctccctttctgagcttcctttcatctctagacttgtctacttgtctgaatttcattaattcataagcaatttttttaagtttccttctgtcccagaatacatgcaaggttctgagataagattgtgatgaagatacagcccctgcacctttggagcataaaatccaatgaaagaataaaaacaaatacaaatcagtgtgagtaagggtgatacagtaggagtacacagagggtgcagtgggagtctgtaagaggggcacctaacttcagtatgcatatttaggaaaagcttgtaagaagactgattcttttcttaaggacgtccagctgtctctcatcttctaaagctgcctataacaagaagctctgcccttttaaatttcccttctgtcttccttacccatccaaaactactttccttgtttgctaaaaaacaaaacttagacataaatcataattgatcctcttttttttttgagatggagtctttgttgccaggctggagtgcagtggcgcgatctcggctcactgcatcctctgcctcctgggttcaagcgattctcctgcctcagcctcctgagtagcctgggactacaggcacgcgccaccacgcacagctagtttttgtatttttagtagggacagggtttcaccatgttggccaggatggtctcaatctcttgacttcgtgatccgcccatctcagccttccaaatgcgcccagccagaattgattctcttaaggatcatttgcattaattgataggagtttattaacataaaagtacttacaattgtactagtagcatggatagaggagaaaatccaaggtcaacctccccttaatcataataaaataatatttaacgtgtaggaacccttaatatttgttagacattaagctaactactttatatatttttttattcaagtgagaggtgcaaacatagcaaactccttgactccaaatacccgtttccctcatgttttacaggtgtcctgttctctgcaggcatctgaaaaaaggtctatttaagaagcccaggttgcttagcactgcagtcacccatattagaaacctttaattcattaattttcagcttttgtgaggtgaggtgggagaatggagaagcacgaatatagtatgaaaaaacgtattcagtgttataattgccttgatttctaaagtcacagtatctaatttattttgaaatttcaaataactataagggaggttgtgaaatatttgtttccaaaagcaagcatggattttaaaaggttcctgtaaaatgctgcttagtctaataattttttttttttttttttttgagatggagtctctcactctgtcacccaggctaggctggagtgcagtggtgcagtctcggctcactgcaacctccagctcccagattcaagcagttctcctgcctcagcctcccaagtagctgagattacaggtacctaccaccatgccaggctgattttgttttatcatgttggtcaggctggtctcactcctgacttcattcaggtgatccacctgtctcagcctaccaaagtgctgagattacaggcatgagccaccatgcctggccagaatctctgattctatttattatatgctagaatttataaagaatgctttttttaaacttgatttatatattcatatcctattttataggtgtcctaattacttgaaggaagtaacactgaacagataacaaaggttgaattctaatgtgttatcacctgacctcattacaatttattgttttgtgagagtggtgaatatgttatttagtatttagaagtctctagaatttaggggtaacacatttttaaatgttgaaaatcaactttattgaggtaaaatttacataaaataagatgcactaattgtaagtgtatggttagaaaattttgacaaatgactatgcatactcatgtaaacattatcttaagaaacagaacatttccatcactgcagaaagttccttcatttcattttgcagtcattcccactcctcttccgtgcttctcccctaggcagttgctattctgctttttgttgttttagtttagtttttccttttctatgttggagtcatgtagtgtttactttcttacatactggtttcttttgcttaccatgatgtttttatgtttcatccatgtttgttgtatgagtagtccttttcttccttcctaatacattgtatggacatacgacagtttgtttatccattcatccgttgatagacatttgagtttctagttttgggctcttatgaataaaactgctgtgaacatttgtgtatgtctttctgtggacacaaattgttctttctcttcagagtaaaattaatggatcatatgcaaatatatgcttacctttataagaaatttccaaacagttttccagaatgttagcacattcccaccagcaatgttataatgttctaagagttctagttgctccacctctttgctaccactgtttatgattagccagactagttggtgtatagtggtatctcattgtggttttaatttgtattttcctgacgactgcagctgttaagcacctttacatgtgcttattggccattggtctatctttgtaatgtgtttatttaagtattttgccccctttaacatttgtcttccattattggctggagagttgcatataatctggatacaaattctttatcagatatccatattgtgaatattttctctgtggtttgccttttcattttctttttctttttctttctttttttttgtgacagagtctcgctctgtcgcccaggctggacccgcctcccaggttggacccgcctcccaggttcacgccattcttctgcctcagcctcccgagtagctgggactacaggcacccgccaccacgttcggctaatttttttgtatttttagtagagacagggtttcactgtgttagccaggatggtctcgatctcctgacctcatgatccgcccttctcggcctcccaaagtgctgcgattacaggcccggcctgccttttcattttcttaccagtgtctttagaatagcaaatgttttaaatttttgtccagtttcctaggttttttttcttttatggtttataaacccaccctaaggtctttttttaatgttataaaatattttgttacatgtattttatctgttttctttttctttctttcttccttttttgtttttttaataccctaaggtcttgacgatttccttttgtgttatcttatgaaaaattttagcttatgtttaggcccatgatctgctttaatttttgtgtaggtcatgagttcaagggttaaggttcatgttaagctacagtaggctcatgtactcatgatgtgtcattatcagcaaaaatagatatgtatatacactgtgtgtatatatatataatttgttatatgtatatgttttctatgagccattgtacacacagtctatatatattttttattaacatatctttagcatatcgtttggttggtaaatcagacttatatttaaaagattgtggctttttgtataaaaatctttagaaaaagtttttattttctattcattatctttgtgttgttttacctgttttatatattgacttcggtgaaatgcttagatcctgcaaagctgaaaatatatgttgtctctggctaacacagagttcaagatcttcagatctggtctatgataaaacagccctgggtactaatcagggttctaccctggcaggacatttctattcctctggctggggccctctttctctcaccttgccctgacagttttcatttgctgtttagaagaaacacaaattctcccttaggaatcaggtaagtatatgaaagagatgaaggaactggttgagctcacagattctttatcttttctatttttttctcttttctgtttctgttttctataagccagggtttttcttccccctgaactcttcctttctcttcccttctttggggaataacttcaggtactctgtaagcacctcctttctttttactgttttcctgagtatattttcttgagagtgagactggatttctgcagaattttccttgagatgctcctagccccatgtcctaagatggttgatttttcttgggttaaacaccaattagggtaccaaaaactcagggcagtggggcagggggagaatttttttactacagagaaatagcatggatgtgaatgggctttccttctagctgtctcatgtctaatacttaatattttgcagtttgccatagctgtttttaatattggagcaattctattatactccgccagtgagaaaacagtatgtgtgactctgtggtgttcttgtgtttgctttgttgatggtggttagtgttcttattttaccatgtggatttacatgtgctactttttgtttctccagatggaacacagtttattactaatatataattattgtcttttcctttctctgttttctcttccttcttgttttacactgtggttcttgtgcaggtcttgttcagcgttgcgtaatcatccagaaagatgacaatggatttgggctgacggtcagtggagacaatccagtcttcgtacagtctgtcaaagaaggcaaggcattttaaaaaacaatttatcactcagtaaacagagtaagaatagaaaagcttaaataatggcaattgccaagaatagaataattacatagattgcaggtcatgtggactattgtgctagattcgtctatcatgtcatagttacaggaaggagtttactccagttgatttttttttgtacttgttagaaagaaatcagtttttatttagttttagaaatcatgtgactccttggtcatgatactttattgtccacacaaaagtttctgaaatttcagttttccatggcaccactgatattttggcaaagacagattaaagagatagctatggcttcagaaataccatttattttcccaaaacaacagtgataatattttctactgctgttaccatatattgaatacttcctttatgttgggtgctataattttgaggtagacaatttttttatccccattttataggtgatattgaggcttagagtaaagaaacatcaaatcagtccaaggtcacacaactagtgagtggcagaagcagcatttgaatgtaaagtctgactttacagccttgttttttttttttgtttttttttttttggagatggagtctccctctgtcaccagactggagtgcagtggcacaatctaggctcactgcaacctctgcctcctgggttaaagcgactctcctgcctcagcctgccgagcagctgggactacaggcacgtgccaccacacccagtgaatttttgtatttttagtagagacggggttttaccatgttggccaggatggtctcgatctcttgacctcgtgatccgcccgcctcggcctcccaaaggacagcccatgtttttaaccagtttgttatactgtctctctgtcaggaagatgatcagtaaatgcaaatgaatcacattttaagcaattaatttctcatacagatggagcagccatgcgggctggagtacagacaggtgatcgaatcatcaaggtaaggaataggctattatagaatttacggtaggattaaaaaacaacatatattggtcatattctgatttttttcacttggatttttataaaaagcatcatacttctatgtatgatagatctgttgactatacaaacttatttcatttgttttaaaattaatactaccctttactgaaggacgtaataaaaggattgaaaataatggaggaatatatgttcttgagtaggagagtaattcagggttggaaagatcatttctgtctagattagtctgttattaagcaattctcatcaaagtacaagttgaacatttctaatctgacacctgaaatgctcccaactctgcaagtttttgagtaccaacatgacaccatgaatggaaaatttcacacctgacctcatgtgatgggtcacagtcaaaagttggtttcaccaggtacagtagcttgagcctgtattaccagctactcaggaggctgaggtgggaggattgcttgagtgcaggagctgagactgcagtgcactttgatcatacctgagaatagccacagcacttcaacctgggcaatatagtgagaccctgtctttacaaaacaaataaaaccaaaccaaaacaaaaaacttggttccatgcacaaaagtatttaaaatgtataaaactaccttcaggctatgtgtataaggtatatatgaaacataaaaggctcatatttaaacctgggtctgatccccaagatgtatcattatgtatatacaaatattccaaacttcaaaaaaatccaaaacacttcttctggtaccaggtatttcagataagcgatacctgacctgtatgcaaatagaattgtagtggtagatgtctatctgattattcttccagatgaactttataaagatataagaatcactaaagataaaaacatgttatatgtatgtgtatgtatgagaagagatgtatatgactctaatctagatatagacctaccagtggaacacaacagagagactagaaatagattttgaattcagatcagtagagaaagaatgggttagttagtaactattctttaaataattgactaatttgattacttaaaatcaaattattacataagaaaacataccatgaaaaataatttggaagaaatatctgaaacgtatcacagaccagatatccttaaatttaaagaacacttttaaattataagaaaggaataaatattctaaaagaaaaatgggcaaagaattttatcaggcagttccctaaagtaactgaaatacataacatattaatgaggatatggccaacctcactgataacaaagaagaagaaattaaaatgataggtgaaaaatacatttggctgtcagaaaatttaaagattggtaatacacatttagtatagtttgggtatggtaaaatgactattctcatgagttcgttgtgagtataaattaggtaaaacctgtttggatgaaagtctgtgaatatgtatcaaaagcctttaagaaagtatataacatgtgacaagcaattttgcttttaggaacttatctgaggaaataagtgtacaaatgtgaagtcgtgtgtacagggaaatttgtactggctttattacataactgtgcataaactgagggacagagaaataaattatattccatttgcagcttttgaaaagaatggattaggtcagtgtgtatctttattgaaagatagctgccgtacagtgaaaaaaaagttttattttttttttccaggaaaaagccagtcgtaatgtataatgtttatgtgtctctttggtgtgtgtatactagaaaagtgtctccaaaattaaatgtcatagctaacagtaactgcctcatggggcaggatgagtatacttgtacttctgttttttacactgatatatttgtattttagataacttggatcagagaattaatcagaaaattaatgttaaatccacatttgatagttttgccttgatttgtttggtttaattcagaatcgggataacattttctacatttagccggtctgaaaattaattttctttgtgaagattagatcatggttgaaaaactaaaagcaaattgaatattgtggaaatacttattttaaaaattattttttattattaattttgacaaattgatgacttggtaattaaaagcaaagagatcttttctatttgtatgagcccttcaccgtgaacgatttgtaaatctgtttcatgttatgttttgtcatttgtcatggtgaataagttgtactgttttgtatgtcaaggcctcggtttatgtttaagttcattttgttgctgaatatgccctgtagaatcatggtgtgaaaatgaatattgaatcaaatacataaatattttaatgtaatgtgattactatattatattggttatattatgtatgataattcttgaagtcattttatccattgtctcaatagaatgtatctgacatacactactttcgttttcttacaggtgaatggaactctggtgactcattcaaatcatctggaggtggtgaagctaatcaaatgtaggtgaatgttattcttagttttaattgttttctgaaacccttaaagtaaggagcagcaaatttcctgtaataggccaaatagtaaatatttaggctatgtggactatatagtctactgccgactctgtcattgtatcatgaaagcagccatagactatatgtaaatgaatgggtgtggctgagcttcagtaaaactttatttgccaaaagtctgtgatcctggtttagccccttggctggagtttgctgatccctgcattgaaggaaaatctgaggtgaaaactcttagcttactaatagctatcttttgtcaactccatttatatggttgattataatattcctgtcattcttggtaatatttgatacatatatttgaaagaaatgcatgagtcacctgagaggaaggaggttgagaagtcagacatatggcctgatgaactgaaatggaactttaaaaatcatctagcacaatcactttccctcagataagtaaatgattatataatccagagtagcgatcttctcttggaaatctttagggttaagaatttgtgatcttcaggtttgagtgaatagcccacttggacttagttctctgtggagaaacaggcttgaagcagtgggagtctgcagctaacctcccgtcacttgcagggtcaaaggtggattcacgaacctcgagctggcagtgagttatgggcaagccaggcctcagccactcacagggcctcagttttcccatctgcacagggagaagggaaggttcagtggccctgtgagctttgctagcaggtggtgatggggtgggtcatctgaatctgagtcaggtggaatcttccccaacctgggctttggtttcattttgttgttatcctttaaccttacctgctttccaagagagattttatgttttcttggttttttttttttttttgtttgtttgtttttagggtagggtcttgtagaatgcaatggtgcaattatagctcactacagcctccaacttctgggttcaagtgatcctcccaccttgttttttgttttttgttttgtcttgtttttttggtagagacagggttttgctgtgttccccaggctgctgtcaaactcctgggctcacccatctcagcctcctaaagcgctgggattacaggcacgagccactatacctggccaagattttatattttctaattgcttcacatactgaatggaaaatagcatgacagttataacagaagtaaagaaagtcacatgagagtccaccacctaaaatataacttcctttttctttgttctggcctggtttgggccgtatgtatttgttattgtatctcttaaaaaaaaaaaaaaaaagagagagactgcttgaactgaatgaaatttttttaaaaaaggaattaaaaaaagaatttatgatcttctgcatcagattattccacagtaaagtagactagaaataagagatagttgtttgtgatcaatcagaatcactactgttttatttaattctgtttctctgtattgggtggatggacatcttcaaaagaaatttaataaactaacttttttcttggcctttttactgctatgttaagcaactatgaaattttttaaactttttcatcagagtaccagtgctccaaatggtcactttgatcagcgttctttagtttaaaagagtgcagtgatcaaaattagatccccatacttgaataaacttgaccacttatttaatgagaatgtgatttataaattgttatgtgctgcataaatatggtttatgttaatgagtttatgcctgatgtccattgaggtgtataaaaacatttctttagctttctaggttatattttttgctcattccagtataaattttacttaaaaaattaaatcctgggattctagcaataaattacttacccaatagtaagggcatagctaaaaacttaaagtaaagcataaaaacctctgcatatccaaaactgatgtaaatttgacatcacatctgtaaagcctgggtgtatgtaacagagttcctgcatgtcctactttctaatgtgtattctggatataataaaagtgatatcaaatcagagcagtttagaaacagctaaagaaaggaagggaaaagctaggaagctattaaaaccaaatacataggcaagtgagatataatagatgactttctgatagagagcaataagattgaagagccttagaaagtgtttatatgtaaaattcctccaaattataacacttgtgagtattatacatagcaaaactagtttttagaacaccaaaacactgtgaaataattgataatgatttccatgggagggttaaattgggagacaagtgtgaaatacatttaaaagttctattgaaatatctaagaaaaaagttttgccatatctattactgactctgattatggtgtttttttttgtttttgtttttgtttttgttttttgagacgaattcttgttctgtcacccaggctggcgtgcagtggcgcaatctcggctcactgcaacctccgcctcccaggttcaagtgattctcctgcctcagcttccctagtagctgagactacaggcatgtgccaccacgcccggctaattttttgtatttttagtagagactgggtttcaccatgttagcaaggctggtcttgatctcctgaacttgtgatctgcctgcctcagcctcccaaagtgctgagattacaggcatgagccaccatgcctggcctgattatggtgatttttgctgtctagattcccgccccccgcaatatgtctactgaattcctgtccattcctccaaatattttctactaaaatttactacttattattgattgtgtttttccctgttattgtggaatattttttggtcatactcattttgtaaagttaatttaaaattgcattttatgttctagcatattcactaaaccctgcctagttagtgtcatcttaaaatatgaagatctaggccaggtgctgtgtctcacacctctaatcctagcaccttgggaggccaaggcgggtggatcgcttgagctcaggagtttaagaccagcctgggcaacatggcgaaaccctatctttaaaaaaaaaaaacattgcagctacttgtgggggctgaggagggaggattgcttgaacccaggaagtcgaggctgcagtgagctgagatcgtgccgcggcactccagcctgggtgacaaagtgagaccctaattaaaaaaaaaaaagaagatttaaaaaatttacatttaagaaattaattaaacatagccactaatagatggttgattttaacactcctctaaataaagaaaatatataatatattcttggagttataaattttatttgcttttaagtaatatctgatcttactagtagtaacttgctatctgaaaacggcatcattcttttggatttttagggcagtcataaaagagaaatgacaaattagtttttttttctgtggagacatgatgtagcagatgatgggactgtcttacataactggatcttttagaactatcgaagattaagtagtaaaatggtataaaaagtttcttgacaatgttattttcccttcccttccctttttccgtctccccaccccaagctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggtaagaatggggaaatttcttagttaaatgctcagtcttataaggatgtgtttactttatatggagagttttcaagtattcggctgatgaactaattaaatttaagattttagaaaatgatttactaatataaaaattacataataggaatgattagaatattgtcatagcagatttaatttaacaagtattagacacctgccatatgtaaaacagtgtgccacccacagaaatatagttaaggtactctatgttcaagattatagtcatcttagaatgtgtacttttaggagggcggggatttttgtttattttgtttactgttacgtttccagtacctgaaatattgcttagcatgtagaaggtgcttaacaaagctttgttgattgagattaagtcaagagtatacaagtaactataatacaaggcagaatgtagacattatgagggcaaaaaaaatgctaagttctatgaggattcaaaggagggagaaagcacatagaagaagaacaataaatagaaggagccaaaaaagcatcaaatattgtggagaagtagctaggatttttggttggttggtgcctgttaaggatgtgcatagtgggagatgaacttgaaaatagtaggttgactatatattttgaaaagtcacatctcccaagctaatttacatgtaactagataagcagtaagaatccattcaatgttgtttctttttaagcaaaagagtacatgattatcctaggattataggaagactaatttggtaaaatattatagggttgtgaaacaaggagggatgatgggtgatgaattagggagctgtcttcatatttcaggtaagaggtactgggagtttgagctatgcatggggatcgatagtaaagatccaaatgagggaaagtaaaagatactattcttatactaagacaacttcatttctccaatatcaatatttagtgttctcttgaatccagtttagtaaaaatgaaatagaagggcagacatttccttgtagtttcttgtaagtgtcatgtctgaaagcctgtccacataacccggaagtaaaaacctaataggtattgataattggagccgaggcagaactttgtatgccacattttctctatttattttagcttcattttgtctatactggttgttgtttgttttttatctttttcttttctaggaggaaaacaatgtggttcataaccagaaagtagaaattctgagaaaaatgttacagaaagaacaggaacggctacaggtattaaatgagaagtagggctgtttacaggccaataaaaatgtgagtgggcatggttgagttggtgtttatcagtcacaatcaagcagcattgtaaccaatgccattagttatattattgattaagaatggactatttctgtatcttttttacataagtaattaattctgaaaatatttttataacttttcagttattgcaggaagattacaaccgaacacctgcccaaagattgctaaaagagatccaagaggccaagaaacacattcctcagctgcaagagcagttatccaaagccacaggctctgctcaggtagcatcactattacaagtgctacccaactttttgcaggagaattttcttctgggaatgtgtcagagaatgttgcagttgccttttttaaagttatttttctagcgtaggacaacaggatgtcctgttaaggatgttacagaagtaatgattaacaaaaataaatgtgggcgtctgattgtttgcttgctcatgagatcacatttctttgttccataataatttaaaaaagaattgagtgcttttgctttgatgtgacaaactactaaaatgtatttagatatatatatatatttatattttttgtggttcattctgccatcttaaaacagaatggcagttgatatgtttttaaataggaatttaagaatttacaacaacaggcattgagctaaatatatggacaagcattttcttatttaatctgcataacatctctgaggttacttatggttgttttcctccagtttacatatatacttagagagagttagagagattaaatgacttgtctgaggtcatatagctgcaaagtaatagaactggaattcaaacccagtctgaggatttaaaagcacattcatactcttaatgactatatttttattgtaatttaaaaatagatttcagtagaatttgctgtatagttataagctatagagataatggtctcataagaaaaaaaaagctcagcatttatatgttaaccagacttacattctgtaatattcagatttgggatatgtaaagcaccttgtacttcatcttaaagcaaagtagataaattgcctatacatttaaaataggtaaaagctgtttttttgtcactgttcccgagttaaatctgaagggaaggctgcatattcgcaaaagaattctttgagatcatctagcctaatctgcttactttctgatttaaaaaaattatgttataattgagaaacctagggtctaaactggttaaatcacctatacaaggccatacagtatgtaaggtcccctgacatcctggtttagtgtacttttcattccattgtttttttcattaccttcagtcccagtagcgatgtcacattttgagtgttacacctcagtaatgttgacagttttatgttattactaggcaaatataatattcttaccctgtttggacagcaatctaaatgcttataacctggccaggcgcagtggctcacacctgtaatcccagcactttgggaggccgaggcgggcagatcatctgaggtcgggagtttgagaccatcctggccaacatggtgaaactccgactctactaaaaataaaaaaattagacaagcttggtggtgcatgcctgtaatcccagctactcgggaggctgaggcaggagaatggcttgaaccatggaggcggaggttacagtgagccgagatcctgccactacactccagcctgggtgacagagcaagactccatctcaaattaaataaataaataaatgcttataacctgatctaaatgcttataataatttatgttatagtattatgtcctagaattggccattgattgacactctgaagcattggaaggtagttaacaagaaactatagggtaataacctttattaatgggcagacaatataaattatataaatataaattacataaattaacaaaccattttatctttttgctatatttagaagtttgaacttacattctttttaccaaaatatcacttgccctgtctttaaggtcatgacattttagaataccggaattagtagttatttatggattttactcgtagaattttaaacatacttgagcatatcagaatgtccaacttttagtagtctccatgtagattgtagtaccactatttctttatgcagcaagtaatgaaagttttcttttatgtgtttgtgtgcgcgtgtttttctttcatctgttttaggatggagctgtagttacaccctccagacctttaggggacaccctaacagtcagtgaggcagaaacagatcctggagatgtactgggcaggactgactgtagcagtggagatgcttctcggcccagtagtgacaatgcagatgtaagctttcagttttctaaatcttttttcttctgtattcttctttacagcccctttctagatttgattttaagtgatgtgaattagaggtgtcttagcactttttaccatccccatttttaatgtaccaatttgataaacagaaatctggttactgttatatataagcttttaattccagagttcactttttcccttgaacacccattgccaactgtttcttttacagggatggaatttcccagcaggcatcttgttcgtgggtagagaagttactaatgccagtgcatttttactgaaccgagagaccaactgttgatatctttaagagcatgttaatattccatttgtggtcagagtgactcagtcttgaatcatggggcactttgccattaccaagaggaaaaacctcagtcctgttagataggcttcagttaatagcccaggtttagtgacagcactttcttgattaacccagaaactgccagatgaacatgactatctgttaagatgataataaaacattttaagctgaatatgatgtaacaccatagacatatgaatacctaaaagctaagttcagtattacttacccagcaatactttgtaaattgtatgcagtggtaggaataatgacttaaatgtagatcaccctctttaaaagtgatgagggaagaagtctgaacgaatgttttgtaattgtgggtcatgaaatcaattttgtgggttgtatttcttttttaaaaaaagaataggaaatacagtgctttgcatatagaagaggtgtcacttcttgggacttttgttacatatacacacatctactatttaacaatgtgaagtttctctcttattgaaggttgttgttgggggattgttttgttttgttgttttttaaaaaggaagccgtggtctaagccatcattcaggctatctcttgaggcttaggcccaatgacccagttcctcatgcaaaaaacaaactgaggatttgtgggttttttgttttgttttgttttgttttttaaggtagtgataggagtcttgtgattgggttagctaaaggttttaatggaaaatttcaatttgggctcaaggaaaaaatggtagtcactaatatttgttgggtatatgtcccatacacggtgataaggttttatgttccttagttaattctcaaaacagccttatgaagtagtactgttgttactgtaactttacaaaagaaaaaattgaggccaaagggagttaactaactttccaaacttattcaggcaataggtgatctacttccacctagctccaaaataccagtaatcgaaatataaacaaaagcactgaggtttgaaaatgcgtaacattttgagagagcagtgagaattttagggcaacctggcatattagggttatagatggaatggctagagattatcttagaagccaaatcatgaatccaggttataaagggcttcaacttgttctagcagtacataccgcttttgggaatgcttttcgtactcttctttttgttttagtaatgcgtctcctcgctgttttcatggcttgtccctaccatgagatgggaagttccttgagagcagagggactgtcttgtctgactttatgtttccaaagtgtagcaaattgtaggcattcagagcaaatgatacgaatgagaaatttgaattttatcttgtatttagaggaatgttacaataaaacatgtgacttagaaatataaccttataaaagagtgaattgttggctgggcgccgtggatcacgcctgtaatcccagcactttgggaggccaaggcaggccagtcacaaggtcaggagttcaaaaccagcctggccaacatagtgaaaccccgtctctactaaaaatacaaaaaaaaattaactgggtgtggtggcacacgcctgtaatctcagctactgcagagtctgaggcaggagaactgcttgaaccagggaggcggaggttgcagtgagccaagatcgcgccattgcactccagcatgggtgacagagcaagactccatctcaggggtgggtaaaaaaaaaagagtgaattgtttagtatagaaataggcattccaatcaattaagactgtttgacatgtaattgatacttagtatttgaatacatgaaatcaatgaataaagtgggctttatcttgcatgcagaagagagacaccatcagaaacatatctgtggaaaatgatttggtgtaaagagggagatctgtaagaaaagaagactgcttggcttaataggaactttaacaaatgtgtgctgaatggataatagttagcatttattcagtacctactttgtgccagaggttgtacccaatgctttacagatactcttttttaacactcataataatcttaaaaaagcagtatcaccatttcatagatgaggaaactgaggccaaataaataaatgaatattgtggaaatccgagtgagaaatgataaagtccaagctaggctatcttctgaacacagaacacacaggtttaatttctacaagtgtctgaggctaaagatgtgttgcttttagcttatggatttccatgtttgtttcaattttaagtatggaggacccggtctgcttttgttgttgttttaacagtactttgagtcgcggttttacattttatcttttgaatcagtgcttttaacttttttcattgtcttctcatttttataaaataatttcctggtggtgtttgtgaaagttccctgcttttgcttaccttggagaaggctttaaagaatgccctgatacccagttctcacaagagaagcaacttggtaacaaatcatcatctgaaattcagagcatctatcattttgattttcagtttgtgagtgatatttttgaaaaattatttattttggaaaattgttaaacatattcaaaagtaaagactaacataatcctcctcatgtccctgagaacctagtctcagcagttttgtttgtaccccctattcctcacatcctccaaacaccagattaaagtaaatccaaggcattcgtttattaatatgtctctctctaagagataagaagtttttaaaatatagctataatattcttattaaatcctaagaattaatattttctcaatacacaattttattaccttgttttataatgatctttttacagtttatttgattcaggatccagtcaaggctttcatattgccattggttaataagtcattttaagtctttataatttataatagtttccttcttttttttccttggccatttgttgttgtggttgttgttaaagaaattgagtcagatgttcagtaaaacaatccattttctaattatattttcatggtgtcgtatgacatgttcctttatctaaattttcttaaaactcctagttaaatctacaagtcttgatcacattaggtttgatagttgttatttggaataattcatagatgatactatgtacatctcattatatcacatgaggatgtgaatggctgtcttactgtggttgtaagcttaaggtgtttaggtgatatcaacatgatttccttcattataacgtcccctgtcaagcttttttttttttttttttttgagatggagtctcgctctgttgcccaggctggagtgcagtgacgcaatctcagctcactgcaacctccgcctcccgggttcgtgccattctcctgcctcagccttccgagtagctgggactacaggtgtctgctaccatgcccggctaattttttttgtatttttaatagagacagggtttcaccgtgttagccaggatggtctcgatctcctgacctcgtgatccacccgcctcagcctcccaaagtgctgggattacaggtgtgatccaccactcccggcccccaagcttttgtgaaatgttttcacatgccatttatgatcaaaatgcctagatccattgtttaattcagagtttcaaaaggatattattataattttgtcagtatttctgtatttattacatggagttatgttacaaaaaatgatttcccttactagctaataggttaccctaaaatacagcttatacagaaaatgtagggtaaatacttctcttgattcttttcagaagagttttttcaggagagatgatactcttacaaactccaaaggtgacaagtgggaagggtatatgtgtgtaatattttgaactcatagatttcagtatgagttactcttttcttttgttggtgggagccccctcaaattttctcctgtgttcttttgacatgcccctccaatatctttgatagctttcttgctttttgtgacagaattattctaatcttttatatatcttgtccaagacctgaaagtcattcatttctccaaggtggggcatacatttgaaagtgctgttttctcttggtaacagaaatatctgtgataccaccaagatatcttgctatatgcataggtaaaatgtatcttccctattggcactcgttaggtctctggttcctcattttcattgctctaaagaatgtctcccgttgctttggggtgttcctcatctccacaaagtgagtttctgtgtctcatatagttcatattttatacagaagttctcagtatttgtggacagcatctgtggattcagccaaccatttatcaaaatattcagggatagaaatgcatctgtactgaatatgcacagacttttttcctagtcattatcccctagacaatacagtataacaactatttatacagcatttatgctgtattaggtattataagtaatctagagatgatttaaaatatatagaagatttgcgtatgcaaatactataccattttatatcagggacttgagcatccattcccccacaaacactgaagaacaactgtattaggtattatacaataccatataaatgtattaaaatccacctttcacatgaagcgagtaacagaatagtagaagcttaattgtactcataagtagggcaaaatgcttttagcttggatagaaaggatagtttgagaaggtaaggattaaggaagataagagagtttgattttgacataatgagtttgaggtatgcagtatatctaattatttggtagaaaagtaacctccaggcctggagattaggtaaaattgttttgttgattctgtattgtttatcaatataaaattgaaaaggtgagagaataagtgacttgccaaagtaaggaaaaagtagcagaaccaagcattttacgaaagatatttagtagttgtaaatacaaatatgaaattcagaacaatttttttttcacacttttttccctcatctccttttggtgtgcctattgaaatgaactgaagatcttgtttttttcattagagtcccaagagtggcccaaaagagagaatttatctagaggaaaacccagagaaaagtgaaacaattcaggacactgtgagtatgaaatccatgcaatgatagtgctgtctttggctttccttatacttaaagtatggtatagacacatctgatgtttacatattttattttttattttttggaaaaaaaattaaaatttattaaagaaacttaataaagatttgaataagtcaagagatattccatggtttgtaagtattcttaggttccttcatatttgtcgtggtggtaacataaaatgtactagtttaaccatttttaagtgtatagtggcattaagtatattcacattgttgtgcgaccatcactgccaaccatcttctccaactgcaatttggtacccggtaaacactaagtctacatttcccccttccccctagcccctggcagccaccattctactttctgtctctatgaatttgactactttagatactcatgtaaaaagaatgatacaatgtttatccgttcatgactggcttctctcacttagcatatgtcttcagctttcatccgtgttgtagcatgtgtcagaatttccgtcctttttgagaccaaataatattccatgacatgtatatacaccacattttgtttatctgtccgtttgtcagtgggtacttagattgcttccactttttgctattgtgaatatgctgccttgccttcagtttttgtgggtgttcatcaagaagaagaattgtttgatcttacgtattcttaattgcatgcttttaagcactctgattttatcttctaattacatttatttacagttttgtagtaaaagatacaacagcattttgtcatctttttattgttagcaacataaggactattgaaaaatcagagacatcaaatcagttataaaatcaaaattgtctgactactgctcgaaactaatttatgttgtttcacctaatttcttttttttaattttttaatttttcctttttttaaagagggagtttcgccatgttggccaggctgttctcaaactcctgacctcaggtgatccacccgcctcagcctcccaaagtgctgggattataggcatgagccacagtgcccggccagtttcacctgatttttttttggaatattaaagccttgaggttaaagaaaataataagagttgttaaaaggcagaattgtgtttaggagactcaatatgtagtgttgcaacactaggaggaaaaactacaggtacatattattcactcagtttaaaacttgcggatctgtttatacaacttcagctatagccactataactgctgtgcaaatgactctcaaatcataggcctacccttctttgctgaactccatccagatcttgcaatgttaaactgctgttagatttaagccaaactcatttttttcctatttcttccaaaatttttattccccaatcctatatggtctttaattttagtacttatggtcttcagacatcctgtatgtatgtatgtatttatgtatgcatgtatttatgtatgtatatatgtatgaatgagacagagtcttactctgttgcccaagctgcagtacagaggttaactgtaacctcaaactcctgggctcaaactgtgtacccactttggcctcccaagtagctaagactatagacacacgccaccacgcctggctaatttattttggtttttttagagatgggtcttgttgtttttcccaggctggtttcaaactcctggcctcaagtgatcctccctccttgacctcccaaagtgctgcgattacaggcctgagctaccgtgcccagcacccatgtttattattttatatattaatgcctctgtactgccgtttttgtgctgaatctaactttgtgagttgacaaatggaggagctattgcatgggaaactatctgacaatctacaatttattcttagaattttgttatctttgtttctatagcagtgtttgtgagattacttgatgattttagagcattgtatcagtgatttttcaatcaagagtgattatgcctccgtggacatttgacaaatgtctggaaacgctgcagctggcatctggtgggtgcatagaggtcaggggtgctgctaagtgtcttagaatgcacgggctagaccctacagccaagaactctctggcgcaaaatgtcaacagtgccgcagttgagaaaccctgcattatacatttatgaaaattaattaaaaatgaaaacatagagttcgatgatagccttcaattatgtatcattaatggaaatcttgggttagtacttctcaggtatattagcctctctgctaactttgtcttaccatttctgctcttatttttcctttctcctattgtcttcattcactttttctttaattttttaattgtaaccatttatgtaagccaactttatttttttctgtaagaagttttaagtatgtatgaattaataaaagaatgtacagaagtgtacagaaagtgttaaagtcagataaccaagtgtatagtgagcaaaggatatttactgtttccaaggggagtggttttttccccccaaaaaaaactcgttgttgtggtctttttctctgccagagtggtacatggccttgaaaatttgtgaacccctactttgaaaataaagtacttcaaaggaaataaacaaaaagaaatctcaccatttaagtgaaccatgtctttttgatgggttggctttattctttttctaaatttgaccaccaggtaatttttctgtttcttttccctgaatgttgccaggacactcaatcacttgtcggaagtccctcaacccgtatagcacctcatattattggagcagaagatgatgattttggtactgaacatgaacaggtgatgacttttttctttctaaaaaatagattgttactttctgcaatatctgatttgttgcaaaaatgagcacgttctggagattaagataacatttgtaaggatttgaagctaaatcttagaaccaatagctccttgggttaattgcttattttagctttgaccaacagaaatgaccttgcttttaaagccagtgagagatcattaatatatgtttaagtacttcattttattggggttgagtgtgtttcttaaaatagtatttttaaaaaaaatttcaaatcccagttcattggtgctataaaggaatatgattagctagattcttgtccttgtatcctgtgatcttgctaaattcacttattatttcttggtgcttttaaaaataagtcttttggagttttctacatagataaatatgttgtctatagtttttatttccttattttcaagctgtttatcttttatttcttgttcttgcctttattgcactggctaggacttccactatgaggttgaatcagagtgacaagacatgcttgccttattcctgctattagggagaaaacactcagtctttcatcattaagtatgatgttagctataagtattttttagaggctctttataaggttaagggttattaggttaaggaatactcctggtttgctgagagtttttatcatcactggatgttgaattttgtggaatgagattattatgtggtttttctgattgtctattaatatggtaagttatgttgattgatattagaatattaaactagtctcgcattcctggaatgaacctcagttggtcatgatatgttatcccttttatatattgtcggtttcaatttgccatattttactgaggattttttacatctttgttgatgaaggatattggtgtgttgtttttctttttgtaatacctttgtctggtttgatagttgggggtaatgctggtctttagaatgatttgggaatatgaaaattgtgatgctagtttacattattattgttttctgtgttcagtatatttagggattatacaaatattctaggatttgtcttacttaaaatcatacaacttcatttcccaccatttctgcaattagcccagaagaaaaggataaacagctattttatgattgggcaaaaagccttccactgcatttctagaaatgttagactgttttttacatactgatttgtatacatccgagctacttgataatcgtctcctaaatttccgttctcccacagtggtctttcttctaacctatccccaagaggtggttaatgttcacagaaagagattccatagcttctgttgctaataaattttagtgaagttttttaaatcttgaattttttatagggagatcaaagtgaaatttggatagctatgttcaattgagcctactttgcatttagtatttgtatgttggagttactgatgcataatcatttcttcctctagatcaatggacagtgcagctgtttccagagcattgaattactaaaatctcgcccggctcatttggctgttttcttacaccatgtagtttcacaatttgaccctgcgactttggtaatatattttacaatctagcagattcagagttcttctgttgattcatgtgccatagaacttttcctagctatacaacgagtgggcagacttctttcagttttccgtataaagacagatacaaaagataattaaaacattatttttaaagacttggttatatagtaataactacattgtttatggtgacctacctgttccagacattcctactcaatggtgacctagcaaattacatttttcatggttcctcattttgtctttttcattcctttctccactacagctctgttatctctattcagacctgtataaacataccaattccaaagaaactcgtcgcatcttccttgagtttcatcagttctttctagatcgatcagcagtaagttgccaagttaatgttgtaatctttgccttagtacatggaattattgtcctcctgcttcctatcttccctcccatgtttttggattttactgtgctttctcacacctgtattatatttcaattattgattactctagacttttttttttttatcatttctaaagtagtttaggcatatgaattctcacagtaggttttaggggattatatatatatatatacacacacacacacacacacacacacacatatatatacacacacacacacacacatatttgtgttttttgcatgtgcataattagagtgaggaaatgaaaaagggaatacatatatattaagacccaaggaataatacttgaataactgaactctgggtggcctctttgaagtttggaggcataattttaactaaaaagtggcagaaaagatttcacttacactgaaataaatgatgataacgttatattttgtcattaaaagtgttaataaggtttttaaagtagtaagttttattattagtcttgttatgggtaaatagcacctagcccttaatgcatactggataatcatgccgcaggtccctagtcctttcacatttgcagttcccttagacgactgcctcatgctttttccctcctaaaacctccatcacttcctttcctagtcctttctcagctgataaccttgaccttattgtttctctgagaaatttaaagtatatagaagagaacttctaccagatgtatcatctgccctcattataccataccatgtactctactctttctcctgatgctatggagtgactgtcttttttttttttttttttgagacagagtcttgctctgttgcccaggctggagcacagtggcacgattgcacctcactggaagctctgcctcctgggctcaagtgatcctcctgcctcagcctcccaagtagctgggactacaggtgtacaccatcatgcctggctaatttttgtattttgtagagccggggtttcgccatgttgcccaggctggtcttgaactcctaggctcaagcaatctgcctgcttcatcctctcaaagtgctgcgattacaggcatgagccaccgcacctggccttgattgtccatcttttatccaaggccagctctgctccagtttacagtgtatttccttatacctactcaaagatcttactctaacaattatcctcccttctcctgcatcatcggttttatattttctacagataatcattcacattagtctgcaaatgttgttattttccctttctaaaaacaaacacacattttggctctacttctccctccaactcctgccccgttttctttgtatgcctttacaaaattgtctgtacactttcacattcaattacctactcagtgactttcctaaccaacctacttaaaatctcaaccctttcactttgtcactttttctattatttttgtccatagaacttttatttagttagttagtttgtttacacagtcagtcttctgtgcctgcagcttccacgaattcaactaaccatggttgaaaatattcaaggaaaaaaacaaaagccaataccacaataaaaaatgaaacaattttttaaaaatatagtataacaactatttgcatagcgtttacattgtattaggtattataattaatctagagatttaaagtatacagcaagatgtgcataggttatatgcaaatacagtgccattttgtacaacggacttgagagttcgctgattttagtatccatgggggttcctagaaccggtaccccatgtggatatcaagggatgactatattcctactctcctaccctgaatataagttttattaggccagatatttttattctgtttgttcactgctgtgtccctaacactgaacagttcctgggacatagcggggtcacttaagtatgtgttaagtgaattagtgttctgatcctactcccattgtttaaaatattgtgttatttttattaaaataatttactttcctaaaaaaatgacaatatattgaagcatgtttgaattttgcatttcttaagagggcaccaagctaagtcaaaactttacattttgctacacatgatctatatatcaatattaaagtataagaagaatccttacactttgattaatttgctaattatacttttatgctacagctcacatttatttcatatatacaccatcatacagaaatgagcttttattacttttttgcacttgagctagaaatgcttttaagaaagttgatttgagctactgcctgtcaaagagaaagttttaaaatccattttacttttcttcaaatgaatataaagagatcttacaatttttagcggtgacttattttcaaatttaaaacttcagatcttataggatgtgtttaaattctgaaattgtatgacttaaataggtatacaatacaaaataagcaggaagaggttaagatattttctcttaatgcaaaataataaagtattcccctccattagtttgggggtgggggaaaacaacagactggtaattattatgcaaatattatggggaaaatcctagctaggaataagtaaattctaagatagtcaccttatttggttcagtagcaagaactgtagatggttgctggagatttaaaactccaaaaactcaacattgacattcaatattttctcactgggagtgtgacattgtgagggctcttaaactttacataggaaaacgattaggaatattattggtcttcagaatgagcatctcaaatataggaaagaaaaatcatggctatatgtgagtacatttttcatatgataatatacacataatttaggttttacctatattgatctaaatgacatataactgattatattgaccaatgattctaggaagccaaagccaaagccagtatattcattaagtgtgtcacagaagcattcagtcatctagctaaacgactgtagacttttcctttatagcatgatcctcgggaaaagggctcattttcaagtttaaacgatagaatgttctggagttgtgaaatgtgaatgaataaatgagcttgtacttgattgtgcttgtagagtgggtatccaagttgtatccccttactttacagaagtacttatgtacatcttcaaatatctttagcgttgttacaccttttgtttgcatttcattttagcacctgaaagtttctgttcctgatgaaatgtctgcagatctaggtaagcttggagcactaacatcctggagaattacatcttaatagatatgtagctcagctcatctgttcaggttttatctgtcacatggtgactagtcgatcacctgaatcacaacagaaagacagtctataatacatttaaagagtaaatgaggccgggcgtagtggctcacgcctgtaatcccagcactttggaaggccaaggtgggtggattacctgaggtcaagagttcgagaccagccttgccaacatggtggaaccctgtttctactgaaaatacaaaaatgagctggcatgatggtgcatgcctgtaatcccagctacttaggaggctgaggcaggagaattgcttgaacacaggaggcggaggttgcagtgagctgagattatgccattaacactccagcctgggtgataagagcaaaactctgtctcaaaaaaaataataatatggctgggcgcagtggctcacgcctgtagtactcccagcactttgggaggccgaggcgggtggatcacgaggtcaggagatcgaccatcctggctaacacagtgaaaccttgtctctactaaaaaacaaaaaagtagctgggcgtggtggcgggcgcctgttgtctcagctactcaggaggctgaggcaggagaatggcatgaaccccggaggtggagcttgcagtgagctgagatcgcgccactgcactccagcctgggcaacagagcaagactccatctcaaataataataataataataataataataataataataatagagtaaatgaaatcagaattctgggatgaaatatacgaactgccctgaagaacttccctctggcatattctaagttaatttgtacgaagtagcattgctatgttgccaattgtatgttgcccagaacatacctttagataacataattcctttcatttatgaagaaaagagaagacctgagctcattcctgaggatctgcatcgccactatatccaaactatgcaagaaagagtccatccagaagttcaaaggcacttagaagattttcggtaagcttagtggtagatagaatttcatatgattattctaaattaatttttttagttaagaaaaagttgctcattaaatacttagcttagcactagataaaccatatggtcttattgttattaaaacataatgaacatctggagccaaagggttagagtggaactgagagtccagactctccattccaggcacttgcaggatctgagctcagtgctgtgtctatgctaagtgtgttcctttaagatattgtatgtgttcttggagtcattgcttctagaattttttcctctggtatcctagatgacatggacccataagtggaaaagtgacatttttcctgttcctagaaaccatagctgtgaagactgtgatgaagcgtccccagaatgaggtagtttttctttaggctacctcaggaaacttctctattcccttcaggcagaaacgtagtatgggactgaccttggctgaaagcgagctgactaaacttgatgcagagcgagacaaggaccgattgactttggagaaggagcggacatgtgcagaacagattgttgccaaaattgaagaagtattgtaagtaatagaagtatatgtggaaatgccctctctgctgagatactagttatgcttgaagtgtcctttgggtaggtttagaaaaactgtcagattgtgtatgtggagccgtttattttgtcatagtacttgagaaactggattttttttttcttttttctgatacttttagataaatttcttgtgttcctttttctgggtggtggtaaatgggtaactctaaaacttctaatcagtgatcaaaaacaggttgattactttcattattttcaatttataggccttggaaatatttcttgccatgaagcatatacagttggtgacatgagggtgaaacagataaggttctttaggggatcagggttcttttggtattttattctagggtgtggcccaaagcatttggctctgttctgttatttcaggtatctgagttaataacaatttttaaggccaggcatggtggcgcactcctgtaatcccagcactttgggaggccgagcgggcggattacgtaaggccaagagttcgagaccaagctggccaacatggtgaaaccccatctctactaaaaaccccaaaattagccaggcatggtggcactcctgtaatcccagctactcagaaggctgaggcacgagaatcacttgcgcccaggaggcggaggttgcagtgagccaggatcatgccattgcactccagcctgggtggcagagtgagactctgtctcaaaaaaattaattaaacttccatatttcatttttaaatttttttttcttttttttaaggatgactgctcaggctgtagaggaagataagaggtaacataactgttttttttcccctagaattttaagaaaaaaagaactatgtttttttcctttcagtcctaaattacaatttatttcttttaacttacaaatacagtttgtggtctctctctggtggcttgtatgttatttgactaatattctactgttgtcctgagtagaattctcttctctgtgcaatgactagttagttctttagtgtttgtttgatttatttcaataattccaaccttggggttttggaaatcatttgatgtctttattctaccaaccctcccttctcagaagtcttaatttacttcgtcctttctcctccagctccaccatgcagtatgttattctcatgtatatgaagcatttgggagtaaaagtgaaagagcctcgaaatttggagcacaaacggggtcggattggatttcttcccaaaatcaaggtaagaatgaaataatgtaatagcatgttcaggccttagggcttctttacatttggttgcagtgtcttccatcatcttagtatttacttaatcagcaaattaatgctagtcatacaaacatttataagatactgtctctgttctcaagaaactcaaaatacagtgagaaatccagacatataaactattattagacaatgtgaaaagtgaaattagcagtttacaaagagtgctatttctgattctgttcatgccttatactttccttttactttgcctaaactaaataccccctgtgttgctacataatcgtcatgaacatctttagtggcagtagagtattctgtcagtttgtaattatttgtgtttttgtttagtgtttactagattgtaaagctgtatgagtacaaggaccttctttattattgtattttcaactgttagcaaaatgcttagtaaatatttgttgaatggatgaatgaattgtttagaataagttcctggtaaatgtgctataaaactaccctttgattttccaaagctgtcagtgataaagagtttgaagaaaacatcttgagtttgaggtgtacacggtactgtgtgcgaacttttaattagtgctctgtgtgcatacacacgtgtacgggttttcatttacacttaacaatttctttgaactaaccattagcattacactatgaaaatcgcaaaagaaatttactctgttacgtatctcttattttttgtacttcaactctagcaaagtatgaagaaagataaagaaggggaagaaaaagggaagcgaagaggattccccagcatcctgggacccccacggagaccaagccgtcatgacaacagtgcaagtatgttgaagtttgaagtgctgcattttcagtactccaggccctcttcacatcagaggcttcttcagctagaatgaatttctggagaaaggagttgttaggatgattttactgaattcccaatatgccttgtttccattcagcgttatttctgaactaagtaccccctatgttgctacataattgtcataaacatctttcgtgggctgggcgtggtgattcacgcctgtaatcccagcagtttgggaggctgaggcaggcggatcacaagttcaggagatcgagaccatcctggctaacacaatgaagcctgtctctactaaaaataccaacaattagccaggcgtggtggcatgcgcctgtagtcccagctactcgggaggctgaggtaggagaattgcttgaacctgggaggcagaggttgtagtgagccgagattgcaccactgcactcaagcctgggtgacactggagcgagactctgcctcaataaaacaaaaagaaaagaaaaaaaaaaaacgaaaacacacatctttagtggcagtattctgtcaaatgtccgtaacatagtttacttacctcttctgattctgtttccattcaacttgtgtttgttaaattaaaaaaaaaaagtgtgtatagatctctccaccacactgaacgtctctttatacatatttacttagtctccatatttctaaaatttctccacctctccattgtactttattttctgatttccctttcaccccaggcccaataaagagagataagctcacttgagatggctgcaggagaaatagggatggtggtaccatggggaggggtcatgtgatggttcttatctcaggcagtagcacatttgaaaatactgaagccaggtgcggtgactcttgattgtaattccagcactttgcaaggccaaggcgggaggatcacttgagcctgggagttcgagaccagcctgagctacatagtgagaccctgcctctacaacaagaacagccaaaataagctgtgtatcatggtgcatgtgtgtagtctgagctacctgggaggctgaggtagtattgctttagtctggggagtccaggctgctgtgagccatcatctcgccactaaactccagcctgggtgacagagtgaaacactgtctcaaaaaaaaaaaaaaaaaaaaaaagatattggcatggtagagtggtgggagtaggattgtgatagtgagtgtcccccacaatgacgagttctccctcaaatgccatgagtgcctcttgttgagaaacattgagaaggtgtgaaatttttagaggaagttaaagagatggaggatttcacagatgctaaccgtgagttccaaggtatacaaaagaagaatttgaggaattaagagattagggtataaaaagttgtgtgagggtgtaggatgctttggatattgaacacctgagtgggagtctttggcttcttgtggtgactttgtgaacaaggataattagcaggatggggattggtctggatggtctttgaggtacattatgatgatgaaggtgtgagtgttgggggagaactggggtgggagcttactaagaactcacaaaaataaagacttcatcttcattcttacaaatgaacacagctccatgtctctcagcattcctcctccctctgtccaccattcctctccttcttttctcatgacccttcttctttccctacatcctcctcttcctcgctttcgtcgtcctgcctcacccctcctccatctcctcatctttctgctctaccttcctctccctttctctcttttcttcttccttccttcatctgtctgtctgtatgtttctctgcataacaatccactatatatattttttagggtctaccatgtttcacacattttaccagattcttttacattgtccttttttgcttttagctaatttgcaatgcagattattttatttattttatttatttatttttgagacggagtcttgctctgtcacccaggctggagtgcagtggcgcaatttcggctcactgcaacctccgcctcccgggttggagcgattctcctgcctcagccttccgagtagctgggattacaggcatgtgccaccacgcccagctaatttttgtatttttaatagagacggggtttcaccatattagccaggatggtctcgatctcctgacctcatgattcgcccaccttggcctcccaaagtgttgggattataggcttgagccaccgcacccagccgcaatacagattattaaccatcattttctgatcagttggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggtgagctattactgtagttcagcttaactaagcatcaagattttaaaacaaacacactaactgaaaaatagagtggcaagttaatcaagactaaatcccagtttaatttaattttgacattttaatatgctacaaccaataagaaatctatgccgaatgataacttaagttctcatttgtccaaaaaaatatttattaagctctctgtcaggcattagctttgtcccggatgttaacatgcaataattatacacagatgcttgcctcatgcagctttctctcttgagagcgatagtcacaaatgtaaaaaatgcaaattgtgccaagtccaatcaagggaaggtaaagggagtattgagggaactggtcagtagttagaggcagatgtgggtatctaaagaagactttttaaaaatctgagattaactagaggttttatttttcaatgttaataggaagccagctgaaagaaagggtagaatatgtgggagacagtatataagtagtagaacagagttgtgaggagagaggagatgagatgtagagtgtatgtaaagggtaagactatttactgagagtgagagttcagtgagaagagcaagggaatttgaagagtaaagaaagatatgaagcaatcgtaggtaattgggcaaggagcttattaccatgtcttcatccttgtttgggaggcggttcaatttctggtggtgacatgatcaagaatgaggctctgggagtggtccctgaggtgccatagaggaggctactagggatgaagacggcaaggaaccaagaagccaggagtttgaatagcttaatattcatggctagtgacgtcaccaagtgtgatttttatcatggagaggaaaactgtgagccaccagccaaaggtttagcattgctagatgattgatatgaggaggaagagaatgtgataatatccagagcatgagagcctcagtggagcaagagattatacaggaagacaaggtcgggtgcagtggctcatgcctgtaatcccagcactttgggaggctgaggcgggtggatcacctgagatcaggagttggagagcagcctggccaacatggtgaaacccggtctctactaaaaatacaaaaattggccaggcatggtgacatgcacccgtaatcccaggtcctcgggaggctgaggcaggagaattgcttgaatccaggaggtgggtggaggttgcagtgagccaagatcgtgccaatgcactccagcctgggcaacagagtgagactccatctcaaaaaacaaaaacaaaaacaaaaaaaaacgacaagataatggtccaaaaatcatattgaggaacaagaaggccattcatctcatctccaccctgacatacaccatataagacagaaatattagtttctgtctcagagggctgtagcagaagaggtaagctgctgggaataggcaggtttctacataaggccaagaagtacaagtgacatttggagaaaattctggggattttgtcaaatatggaactctgaagatgttagattgggtatatgcactgatatttcatggctcctgtgacttattaaaataaaaacatggtaggtggcggatgaacagaaaccataaagagaaagaaagtagaggaagggaatgtgttatcaggaaataagagattttaacaaatacttgggagattgaaagcagacaagagtgtaaagaagccaggcatggtggcttactcctgtaatcccagaactttgggaggctgaggcaggaggattgcttgagcctagaaattcaggaccagccagggcaacatgaaaagactgtctctacaaaaaatgaagaagtcagccagtcatatggcatgtgcctgtagtcctagctaatcaagaggctgaggtgggatgatcacttgatcctaggaagacaaggctgcagtgagccatgttcttgccaccgttaatgcagcctggatgacagaatgagaccctatctcaagaaaaacaacaacagagaaccacaagataaaaccataaaggaagccagagcccacaatttgtttaaacagtccaagatagaacccagtctgctcattggaaccctggagagactttgggctcagagttagcatatgttatgcagtgcaggaataagaaaaagagcaaaaatgatgaactaattgcaggtctataatcaaaatagttatatcagcagcttctaatccctgaattacagagtatgagcagtctctgtcacttgtagactagaagaaaaaaacagtgctcttttttaaaataattcagtgaattgtgtagggagagttaagtccctccgcagtattgatcgcttggagttctgacatttgggagtccaaagcctgacactaggcatgccggcaacccactgtgctcagagagctctcaactgaaacagacctattactatatagcagcaaaagaaagccaagtcagctactcactttcatcattaaacacgaacatcattactcacccttgtcagagtcaagacgtaagataatatataatgccaaacatatcagacaatgacataaagagagaatacagttaaacagaagaattttccctacaagagaaagataatctgataatagacaagaacttaagaaaatacttctaaattaggtagtatacttggggacattaaagaagttattatctctataaagcaagaatagggagcattcagagacaaaatatttttaatacaactattaaacacagtgacatctgttgtattatcaatttctgtgtgataaattaccccaaaacataatggcttaacacaaaaaaaatttatctcgactttttggtggatgaaggactccagagcagcttagctgcgtgggtctcggttggagtctgtcataaagttgcagtcaagatattagccagtcatcagaaagcttaactggggctggggaacccatttctgtgcccactcaggtggctgttggcaggaggccttagctcctcactcatggccttggctccttgccacatggacttttccatagagatacttgagtgttccatgaaatggtagctggcttttcccgagtatcccaaaaaagagagcgaaaaggaagccccaatgtcttttctgacttagtctctataggtgcactctgtcacttctgcaagttagaaacaagtcactaaatctagcccatactcagggagggaggaattaggctccacccctgaggggagaaatatcaaaaaatgtgtgggtatattttcagaccaccacagcgatcagagtttaaaggaaaaaaaagaagtccctaaaattaaagtcaaggaaatattttagagtgtacatcagaaatatgaaaggatagaaatttgagagaaaagaattatatagggaaccactacagagagccaacatctgtctctttcacaaaaagtcagctgaggacatggagaagagatggttaaacaacaggagaaagtttcccagagttgaaaaagaatacccatcttcaggtggaaagggctcactgagaaccatctatagtgaatgctttttaaaaaatccattcctaacatgtcctttgaaactgtagtgcaccagggataagctttcagaggaaaaaaaatggggattacactgcatcacattcctcatcataacactggatgctgaaatacaaaagagccatgccttcaactttctgaaggaaaatggttttgaacttagaatcctgtatccatccaagctattcatcaaatatgaagaatgaataaagacattttcagatacacaaggtccacagtttaactggaatgtacctttccctttgaaatcatttgaggatacacattctagcaacatgagaggaaaaattaagaaagaaaatgtcctgggatccaggaaacactggaaacacccaggaaagtggcaaagggcaattctaaaatgatggttgtgtaacaggccaggagagccactgctccagattggaacacaagaacatcacagataagaaaatggggattttaggcagtggatagtatgaagcagcagaggaaatagtttgagacttgatagaattatataactttgacagcaataaaagaaaagcatttagaaatgttaagaaaaacagaattgttcaggaaaataagtcatgatttaaacatgaagcaaaataaaaagtggcatgatctttagcaattgatggtgtgtaagaaagactttaataaatgttctatttgaagtggcccatggattgcatcattggaccggtaggaaaaaatatataatcctaactagtatatttcttaatctggcaggaatgatgtatatatgtatgtagtagacgacagtatatatatgtcataagcattctttcttggttttcagacttttagaataaccctaccaggcaagcatggagtagttcattatggctgcaggttagaatataaatgtaaaaaattcttttaatgatgcaagtaaaaatgtagttgaaagaaatggaaggtagaaggaaggaaatacaattagagggaggatgtggacactgaatacctaatctgacacagaagagagttgagatactaactttttgatagaacaaaaacatagacatgtcatttaaatttaggtagtaactaataacccagctagtaataatgataaaactattaaacattgggaagaaatggtagaaaagtgaaagtggaaagtgtaagtcaacaaaatcctcagaggggaaagaaatagatattaactaaagataataaatcatgaaaaagaggttatttgtagttggaccactgtaataactcacatttgaaaacatgaaaaaggattgatactgggagtagaaaaggataagatgggaaaatgttgttcctcatcatatactcttctgcactgtgtgagtccttgctatttcttacgttaatttttaagaaacagttttaaaaattatttttctgaccaggcatggtggctcacacctataatcctagcactttgggtggccaaggcgaaaggattgcttgagcccaggaattcaagactagcctgggcaaagtagcaaaaccctatctctacaaaaaaattaaaaatgagccaggtgtgtgtggtggcacgcaactgtaggccccgctacttggaaggctgagatggaaggatcatatgaggctgagatgggaggatcatgtgagcctgagatgccataattttgtatattaaatttttagttctagtgaacctgcagttgtttaaataagaatgtagctatggattaggctgaagctgttctgggaactaattttttttggtgaccagtgactttattaagtattaacactcttcaaatgtctgacttttgtctacaggatcaaagcaagttggagaaacatcagcacctggagacaccttagatggcacacctcgtactctcaatactgtctttgatttcccaccacctccattagaccaagtgcaggaggaggaatgtgaagtagaaaggtaattcagtgatctcttagagaagcttagggcattacttaaagtttttaaattatatgctattcctatacttagtagcattctagcactgaagcctggcatggtggtatgtacctataatgccagctacttgggaggctgaggcaggagaatcaatcacttaaactcaggagtttgagaccagcctgggcaacgtagtgagcccccacttcaaactgtaaaaaataaaataaataaataaataaataagttgggtgcataaaagaactaaaacaccatttcagaactcataactgaaatgtagaaaggtactcaaattttcttcaatttattttatattaaattattacaatatcccaaagaattatttatcaagctgctggagtttaacctagctttgagtatctttggtataaatgtattgatcaccattttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatggtgagtgtaatcaatttgttgttgttgtttacaaatactgagttttgtcagagtgaattaagtctctcagccttggagtttgcttcaaagtttctcctagccttttgttttaaacaaagaggaaattaaactggacagataatccttgaactcaagaaaatgcaaatgtttctctgattcttattgataatttaaaaggaaaatgtgttaagccttaaagatatttaagattcatagcattatagatcttaaagttgaaaagtcattgcaacaactaagttatttttatgcatagattttaaatgaggaaggtaaagcccagggagattgaattcgttaagatcatacagctaataacgtgtaaggaaaaaaattcagttcctggtctttctgtatcgaagtgcagtgttctttatttaccctagcatgtatgtgataaatgtgtggcatgggtgctgtaccctttactatccttagcatgtgatatgaataaatatcttgtctctgacaatactgagacataatgaaattataagcctgaccccagaagtgagtgtttataggcaaattagataaccaaaagtactattatttcttaagagggctcaagttaaaggctatatgatgttggggcttacagttttcttaatgatgtagttgtgataggtgggtattattgtaaacagctggatgtgtttgggaatacactaaaaaaaatagttttgaatgatattttttatttgtcagtattcaactctcagagccagtatgtaggaaaatttcttggaatcagaatgacttcagagatatttcatcctttctaaatgataaataatttattatataattcatttgctacttcactccagctaaagactatgattgatcccatggaattgttctaagtaaggcaacatttcatatctctttcctgttcagaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatagtaagagaaattagctctgatctttgcccctaacatttccaatagagaaaagattgtgagtttaaaattttgtaaatgtacccatgttagtattcctgagattatgtgtgagaatgtaagataaataaaggaatgattggaactttgactagatccttttcctcacaatcaatctttcatgtacaatgtgtcaacatagggcttccagtctaaagtcattgcctaaggtgaaaaacatgaatagtcaaattcaccgttgaaaattttctatcaattatagtatatatatctctttaaatatatatatccaatataataatatacgtataaatgtgttttgtaaatagtagtgtatggtatataatcacatggttcggtaatttttaggaattgtttttatttttttgagatggagtctcgctctgttgcccaagctggagtgcagtggtgcagtcttggctcactgcaacctctgccccctgggttcaagggatcctcccacctcagccacctgagtaactgggattacaggcgtgcgccaccacacccagctaatttttgtatttttcgtagagatgggtttcaccatgttggccaggctggtctcaaattcctgacctcaagtgatccacccgcctgccttggcctccaaagtgctgggattataggcatgagccactgccccggcctcaggaattattttattgttttgttgcttggaacacttgaataagtatataaaaattctaccttgttgacattttattggttgaagtcatcttggacttttgtggacagtaatatgatgttcctctcatttataggtcactatttctctatgacccttaatttttttatctttctttttcatgtcatcactaactatcaacatctgctaactaaattgatgccttttattcctttgtggataatcttgggtttcacaggcatgcattgacaagttcaggcttgattacatccattgcctgcacacttaacacattttgagaggatcagtgaacagaattacttgtactgtttaaattcaagttctttttgagcatgattatagatggagtcttgaggttcaatgaatatttgatgcaaccaccgtgtatgtaatgtgctagtttccaaaaatgttttttgtttagcacctgtttttcagatagagcttataatatccagatgtgtaagcactatgtccagatttatatttaaggagataagaagcagctgtactactgtgaaaatcgtctttataaaaaaaaaaaattagctactctgtactaccagtaattctgtctacactgaatgtgttactaacgtttttctatctttttatctttagttggattgaatgaacaaatgaaggctgttcgaaagagaaatgagacctctgttatcgatcagattggggaagatttgctgacatgggtaaggaaattttctgtttctttttaatatttttatggacacttgatggttagattcaagttgagtaactaacctttccaaatatgcaaactcatccatgttgcaaagttaatgcaaagctgagaaaggtcaagcagtagattccatttcaagaaaccacctgttttgctcatctgtaagaagcagacccttatccattaaaagtcataccatgagattgcagtgattcagtcacaccttcaggctccactgtaatcctagtttttttgcagttacctcttccactgaagtcttgaacccctcgaagtcacctatgagggttggaatcaacttccaaactcctgttaatattgatattttgacctcctcctgtgaattatgaatgttcttaatggcatctagaataatgaatccttttcagaaggtattcagtttgctttgcccagaccaatcagaggaatcaccttatgaaatatatttcttaaataataagacttgaaagtgaaaattactccttggtccatgagctgcagaatggatattgtgttagcaggcctgcaaacaacattgatctccttgtacatctccatcagaagtctttaagtgaccatgtgcattgtcaatgggcagtaatattttaaaagtaactttttttttttctgagcagtaggtcttaacagacatgctgtcatctaggctttgttgtttcatttatagagcacagacagagtagatttagcattattcttaagggtcccaggaatttcagaatggtaaacaatcattggcttcaacttaaagtcattggcccctaacaagagagctggcctttcttttgacatgctgaagtcagacattgatttctcctctctagctatgaaagttctagatggcatcttcttccaatagaaggctatttcatctacattgaatatctgttgttcagtgtagccactgtaatcaattatctcaggtacgtcttctggataacttactatagcttctactgctatatcagcacttgctgcatcactttgtacttttatttttatggagatgacttcttttcttaaatctcatcagtttacccctgctaccttcaaactcttcgtctgcagcttccttacctctcagccttcatagaattgaagagaattaggggcttgctttgtattaggctttggcttaagggaatattgtggctgatttcatcttctttatacagactaataggctgtttcactttcctcttgttcatttgttcattggagtagcacttttatttccttcaagaattttttctttgtgttcacaagttggccatttggcgtaagagccaaatctcagcttttgacatgccttccttactaaacttaatcatttctagcttttaatttcaagtgagagatatgtgactcctcacttgaacccctaaagaccattgcagcattgttaattggcccaaattcaatattgttgtgtctcagaataaggaggcccaaggaaagggaagagagttgggggaatggtcagttggtggggcggtcagaacacacacaacatttttccattaggtttgccaccatatgtgggtgcagttcatggtgccccaaagcaataaatagtaacatcaaagatcactgatgacagatcaccgtaacagagtaaaatgaaacagcttaaactattatgagaactaccaaaatgtggcacagagacatgacatgagcacatggttttggaaaaacggcaccaacagacttgctcagggttgccatcaaccttcaatttgtaaaaaatggagtatctgcaaagtacaataaaaatgtgaggtatgcctgtacctgtaaaaagttgaggaaaagcagaatggtggtttgtaactgtcacatacaaagcgttaatttagaagaaggcattggccagaaatcataaaagcaaaaatcataaataggcctttagattttactcttgctgtttaaataaaatcattttggaaagtatttttccagtattgtttccttaagatcactttacatacacagacaatccttgacttactatggttccaacttcgacagtttttttactttacagtggtgggaaagtaatacacattcaatagaaaccatactttgaattttgaattttaatcttttccggagcttggcaatatgtggtatgttactcttgatgctgggcagcaacagtgagccacagctcctggtcagccatgtgatcacagggtaaacaaccactctacagtgtactgtactgctagatgattttgcccagctgtaggctaatgcaagtgttctgagcacatttaaggtcagctaggccaagctatggtatttggtaggttcagtgtattaaatgctttctcaacttaagatattttcaatttttgatggttttattaggatataagttcatcagaaatcaaggaacatctatacttaaactgcttgtaaaactactgtagaggccgggcgcagtggctcatgcctataatccctgcactttgggaggccgaggcaggcagatcacctgaggtcaggagtttaagaccagcttgaccaacatggagaaaccccatctctactaaaaatacaaaattagccaggcatggtagtgcatgtctgtaatcccagctactcgggaggctgaggcaggagaatcgcttgaacctgggaggtggaggttgcggtgagctgagatcgagccattgcactccagcctgggcaacaagagcgaaactcagtctcaaaaaaaaaaaaaaaaaaaaaccaaaaaaaactactgtagaactgcttgagtttgggggcattattttctttggtaaacccagctgctttttgtagttgtgtggtgctttgattgactaacatgctaaaaatgctgccagtctccttgttaaacatgttaaatgtcatattcatcatagagtaagaatacaaaattggagtgacctattaaaatattgctttgtatgtgtcctacttgaaaaaatactctgaatttatctacaaatgcgctacaggcgggctttttacaaaatgcctttatgtacaaacttttgggaatatggctttaaatggaagattatatggaaaacatcttcgtaaaccataaagcaattatctacaagtatagaggctgtattaaaaaacaatgtatttgacttctacgagcacctactagtaaatcactttttaggtgtttaaccatcagaaatcttaaaatcatggcacatgcaaacttaaatttacaaattaaaaaacattagtgagaagtataatttttagcaaaagaattcataagctcattgatctcccccaagccagctccagctgctgcacaggtgaaacagcagtgatttaattttgtttcaacacagaaaacttacggcctgcccatggtcatagtgggttttatactgagtaagaaggaatgctagtatgccaaggatttgcttcccagagtagtaagacagtagttgttgtaaaggcttcagggtgtaagaaaattaaattttaggccagatgtagtggctcatgcccataatcccagcactttgagaggccaaggcaggcggatcacttgatgtcaggagttcaagaccggcctggccaacatggtgaaaccccatctctactaaaaatacaaaaaaaattagccaggcgtggtggcacacgcctgtagtcccaactacttgggaggctgagacaggagaatcactggaacctgggaggcggaggttgcagtgagctgagattgcaccactatactccagcctgggccacagaatgagactgtctgaaaaaaaaaaaaatgaaaatttagtctcagtcttcaggcattttgtatcttatattctccaaatgtcagcttgtctgtgtaatttataagtaacgtaggctgaaaggtaataggttgtgataggctacaagcaagaaaacattgggactgggcacagtggctcacgcctgtaatcccagcactttggggacaccaaggtgggcagatcacctgaggtcaggagtttgagaacagcctggccaacatggtgaaaccccatctctactaaaaatacaaaaattagctgggtgtggtggtgtgtgcctgtagtcccagttacttgggaggcagaggtgagaatctcatgaacctcagaggcagaagttgcagtgagccaagatcatgccattgtactccagcctgggcgacagagcaacactgtctcaaaaaaaagaaaaaaaaaagaagaagaaaacattggaatatgatcagaaaaggtctggttgtgtcaagatcagacctttttaatggagaaccattgatattccacatagatatgcagttctgtgtattttgtcacttgaaatattgaaaggattctggttgtctgtcactttgtctggcttgtataagctcagtttcccattctcttttgtgttctttgcattcttggcacagttcagcggaccaggagaggagaaattgaaacatgctgctgctaccttttgcagtaaccaacctttcgccctggaaatgatcaaatctcgtcagaaaaaggattctcgatttcagacttttgtgcaagtgagttgagtgagtcatgtaagaaaaaaaataaggcaagtttttatcaattatcagataaactgggggaattctgactaagacttttacaaagattacatctgtgttaactttttttttttgagacagggtctcgctgtgttgcccaggctggagtgcaatggcacaatctcagctcactgcaacctctgcctcctgggttcaagcgattctcctgcctcagccttcctagtagttaggattacaggtacatgctaccacgccctgctaattttttctatttttagtagagacggggtttcaccatgttggccaggctgggctcgaacacctgacctcaagtgatctgcccacctcggcctcccgaagggattacaggtgtgagccactgcacctggcccacgttaacatttttaaaagcaatacattatctcttaaattcctggaaggtacaaaaatgactttggaatggtgaagaataataaaaaatatatgtcaggattaaaatacttaatatagaaatccacattgccacgaggcttttatcagtaaacaaccgtatgctctattaagagaatattgtcaaagcatgagaatgggtttatccagggaaaaacgtaacagcagccacactcattggggtatatgaattaagggttggtaaactatggccgacagaccatatctagtctgttacctgtttttataaagttttatgtaaatacaaacatggccgcttgacagatttctcacagttgttgtggtgtgtgggtatggtttagcaggttcctcccttgagagtttgaccaggctgagatcacagcgtcagcgggagctgcagttttcatctgatgctcgaggttctcttctaagctcactggttgttagcagagttcatttctttgtaaatgtataactgaggtcctaccttgctagctattggctaggaaccagtttcaactcctagagaacagagagatctctgccatatggccccattaggcagtttagaggtggatgtttgctttcttccaggccagtaggaatgtggctttctgacacagatttgttttaaaggctcctctaatgaaatcaggcccagccaggataatttcctttcttatgatctcaaaatcatgtggtggcaacctaatcataggtgtgatatcccattgtaatcacagattccaaaaatgttcatactcaagggcataggattacacagagtatttacacaagaggatgggaaccttggaggccatattagagttctttactacacagagccttgttcattcacttatgccaaaacagtagagctgaatagttgtgagagagactatatggcctgcaaagcctaaaatatttactatctggcattttactaaaaactttgcagaccactggtatagatgagctggcatactcgactggttatccattgtgcatacttggaatggcagataacaaattagctaaccaattttggtaggaatgtcaatcataggagaatggacctagattttctgaataggtgaagataaaactgtttcaacacaaggaagcgatacgtagagctgcttatggatgctttcagtccttccttaaacagataacaagccattcatttagtaatagaggctcccttcccccattatgtgattaaaggagaaagcagaagtatattgtggcaatgatatatcttggcattttttaaagatcttgatttaataaccagaactgtgatgcattaaaccctcacggtgaatacatggtacatgtataagttcaaataagaattacagattcacttatttcactttaattttaggatgctgaaagtaatccactgtgtcgtcgtcttcaactgaaggatattattcccactcaaatgcaaaggcttactaagtacccacttctgttggataatattgccaaatacacaggtacagcattttcactgaaataaaaagcttaagaacaacaacaacgaaacacccaatatcctgtaaataatatcttacagcgtcctgaatggagttggatttccaaatagtatgacaagattttctttttttttttttttttttccttttttgagacagggtctcactcagtcttgcaggctggagtgcagtggcacaatcatagtttcctgcaacctcaaactcctcggctcaggcattccttccacctcagcttcccgaacagctgggactacaggggtacaccaccacacttggctttttttttttttttttttagcaagggtctcactatgttgctcaggctggtctcaaactcctggcctcaagcagtcctcctgcctcccagagtgctgtgattataggcatgagtcaccatacccagccaagattttctaacaagatatgatctagtcttcttcgggctgtttgatataatgtactccattagtagctttagtacggggtatatcaaactatgaatcatagaccaagtcatgctcactgtctgtttttgtaaataaagttttattggagcacagccgtgctcgtctgtttatgtactgtccctgattgcttttacattataacagcagagtcgagtagttttatcggtgcccatttggcctacaaagtgtaaaattatctggttcaaccatccttgttctagcctgcatcatttttgctttgaagaaggttcatccttggctgaagagatgtttcatggatatctatcaatgacttttattaagccaaatcaatgcggtgtaattccaactctcccgttttgaaacatgaaatgaatctgtttctcagctgagctttaggttcttatacttagctctcattaataatttaatgcaactgaaatcttgtttcttgtgcctgagaatttgaatgcataagcaggaaattttaaattatggtacctggtaacaaaagtggtttacactcatacatattaatttttacactttaatatatctgctcagtgtagttagactgtggtttggaggattataattttgaatgttctgattttggtcttctttgtattatagacatgacatagcctcaatacgttttgtcttgttttgttttgttttgttttgtttttttgagacggagtctcgctctgtcgcccaggctggagtgaagtggcacaatctctgctcactgcaacctccacctcccgggttcaagcaattcccctgcctcagcctcccgagtagctgggattacaggcgcacgccaccacacctggctaatttttttgtatttttagtagaaacaaggtttcaccatattggccagactggtcttgaactcctgacctcaggcagtccgcctgccttggcctcccaaagtgctaggattacaggcatgagccaccttgccttgccgcctcaatacgttttgatgaatttcatcttcttttaatgtaatctattttctttctttaaatataatctcaaattcaaagaaacttgttttggaattattttgaattgtgttattaaaaaattttgtttaacaagttcactggacataattatgtaggctatgcactgtgaaattctgaggggagaagggatttccatttatattatttacaaagtaaatgagacctgcccttctggagtgtatagtatagtggtcctggtacttcacgtaaagcatctcttcttggatttcgggttctgtactgtgatttctttttaaagattagaatttatgttttaaagtcctgttataagaagttttacctgtccaaagactgcttgaattgagactctgacagaggctttaagctggtacaaaaatcttcaaggtcttaatatgctcttaaaagtattgaaatgaaatgaaatctcatttacatatattttatggttttttgctcagttcttttacattttggatttctttcccatatttagaatggccaacagaaagggagaaggtgaagaaagctgcagatcactgtcgtcagatcttaaattatgtaaatcaggctgtcaaggaggcagaaaacaagcaggtaaaaaaggaaaacaagaaggtacaggatgacattgggagaacattaaattaatattacctggaatctgtgaaatagttgttaaaactatcattacctaatggacagggagaacatttgtttactgttcgcatagtaggcaggtcaagatcaatctgtgatagaatatcggagttgtatttgactttttgaaacacctcaagctgcttgtttgctctttcatttatctcttcattcagcagatatttatagaacatctactgtatgctgggcatagggtacagagtagttgagaaaatgagtgcaatatctgcccacactgagcttgtttgctaggaggatagaaaggcatttaacaggattatagtgcaaatattttgtatcagttgtgatagctactatcaaggataatttcaagatgctacgatatataactatggggcctagcttagtttggggatgttaggtggtgcctattagagaaaattttcttgaggaattgacacttgagccaagctctgaaggatgagtggaagtgaaccaaaatgatgtgaagggtgcaaccctagaggtagaggcaatatataccaaagtcctgacggaaaaagaaagcatggtctgttggaagaattgaaaatttacatgagtgtggatcatgcctaaaaagcaaagtcagagtggcataaaatgaggtaaagtagaccaaggccaactcataaaggccctagagatcaggttaaagattttgatttgtcttcttaagtgcagtaggaattcagcatagacaagtaagaatatagtgttcagattttcattatctgaactagtactctatggagaatgagttgaagaagggtggtggatgaaagagcccatttattaacctcttgcagcaatctaggatagatgatggcagcttagagaagttggagaagtatttagaaggtaaaattgacaggacttgatgactgatttgaagaaggatttgaaggaaaagtgatgtcaagaataaacccccaggtttctggattgcatatttggatggacaggatgagtggagaagccccacgtttgtggggaagatgatgaggtcactctgggatatcaggtagacatgcacagtaagcagttggctgtatgggcccacctctaagaggaccatgttgaagataaaaattcaagattgtgagcatacaggggctgattgaatccgtgaacacggatgtagtttcttaggagctgagtatgattacaactctcttggtgaggctgtagaaaaactagtactttcagctgtgctgttcagagtgtaaaatgataaaaccccagagggttatgtagcaatatttatctaaattaaaactctgtaggtacccttatatctaccttttgactccgcagttctgttcctagtgatttgctcaagagaaatgaaccatattagagttctttactacacagagcctgttcatttatgtattatctgtggctacttttgttccaaaacagtggagctgaacaactgggagagagattatatggcctgcaaagcctaactgacattttactaaaaaccttgcagacccctggtatagatgagctggcatactcaggctggttatccattgtgcctgccgggaatggcacataacaaattaactaactaactttagtaggaacaccaatcataagcaaatggacctagattttctgaataataaaatatatctttatctgaagataaagatatacccacaaacagacttagaccagaatgcttatagcaactttattcataatagcgaaaagctagaaacagcccaagaatttatcaacagaatggataaaccaactgtggtatagttataaaatagaatgccctgagtgataggaaaggaatgtaccactaaggcacacaacatggatgaatctcacaaacatgctgagtggaaaaaaaacagatgcaaaagagtacatacctatgattccatttatatgaacttctaagagagaccaaactattctatggtaggaaaaaccagaaaactggttcccattggggatgaggaggtagaaattaactgggaagaagtatgaggaaactttctggggtgatggtaaaattttctatcatgatagaagtttaggttacacaaatgtgtaagcacttgtcaaaattcatggaacatacacttgaaatgtgtgttctactgtatgcaaattttacttttttaaaaagaactgtatggatgtttaaatgtttagaggtaaagtgtacttatgtctgtaatttattttgaaatgcatccaaaaaataagatggactgatggatagagggatgaataaatagatatatgataaaacaaatagagcaaatgttaattgtagaatatagatggtaatatataggtgttcactatgctcactcagacttttccatgtatttggaaatgatattgtgggggaatgtacataccctttgatccaacagttctggaaatttatcctacagatatcctacatggatgtacaaagacatatatttaagtccactttattacagtattgtttgttacagaagagttgaagtaacttaaatgcccatcagtaaggcgtaatgaaataaattatagtttattcagagagttttacatcctgtagtcatttataaaaaaatgaaataactctctatatgtgctaatgtggaacagtccccaagatataagtcatacaccacacacacacacacgtgggggaatacgtatatgaatgtattctaccatttcaatgaggaatacatataggaataccaaaggaatgcatatatgaatatattatgctaccatatcttgttttaaaaaaggacatatacacacaacatgcacaaagacaagcatacttatatatacatatataaataaatacatatctgtttgcatagaatttttctcaaaggctacccaagaaatggatattagtgattgcttctttagggaaaattgaggggggtggggcaataggacaaggttagagggagactttttattttttgccttatatagccatctgaattttgtactgtgtgcatgatttacatattcagaaaataaatataagctaataagagaccaatgactttgaaaagaagattgagaaagaaaagccaaagaggcaggaggaaaactaggagagtatattatcaccaaagccacgggaagagagtgagttttcagtcctgtctagcattgcaaagagctcagtaaaatggagattttttttttttgagatggagtcttgctgtgtcgcccaggctggagtgcagtggcgtgatctcggctcactgcaagctccgcctcccaggtttgcaccattcccctgcctcagcctcccaagtagctgggaccacaggcgcccgccaccatgcccggctaatttttttttatttttagtagagacggggtttcactgtgttagccaggatggtcttgatctcctaacctcgtgatccacctgcctcagcctcccaaagtgctgagattacaggtgtgagccaccacgcctggccaaaatggagattttaaatgccaagtttgattcagaaatagagaggtcattaatgaccaaagcactaaccttggttccaccctgcctaattttcagcgcctagaagattatcagcgtcgccttgatacctccagcctgaagttgtcagagtacccaaatgttgaagagctcagggtgagagatggtctaatcataatttaaaaaataaaataaaatttgctaaagacctggcaggtaattaacatctcagtgggaatatacgtcacctgaaggagttcttgtatcgtagattatctgtatttatgattttttttgctgccttttaaatgcttgatctgtatgaaattagtttttcattagaggaatatcttgcataaaactgtaatattacatgacagcaattggcaggagactaagggacactaattattataaaatttaattttattgtgttctgtagtttgtttcagacagggtcttgctctgttgcccaggctggaatgcagtggtgcagtcttggctcactgaagccttggcctcctggactcaggcagtccacccacctcagcctccctagcagctaggactataggtatatgccaccatacccagctaattctgtgttttgtaaagacaaggtctcgctgtgttgtcaggttggtccagatttcctgggctcaagtgctcctttctcagcctcccacagtgcagggattacaggcatgagccactatgcccagcctgtgttctgtagtttaaataagggtaggactgtttggtaactttccagatcatttaataacacaagatagcatactattttctcatgaggctcttcagaagcataaaagttggaaccattacaggaacgatagtaaaatgtttactaattgccacttctagtatgtgggcttatgtgttaactttttcggattttaagtgtttttgtaccatttcactaggtggtggttttggcagatttatttggtggctgttaaaatagacttttatgtcatatattaatacttcgtcaacaagcacgtaaatgtgcttattccccttagcttccaaagaatgagagttttctagagctgctaatactaaaagatgattctcttactaataagttgttaatatttagaccaagtctgagtagtacctggacttttcatgagtactatttcttagaactttctttgaaattagagccttggaactcagaagccactttcttatagacaagcatatgtaccatgctcatccagttattcataggaaaattaaaggatacgttgagaatctagtgactgaatgtttgtaacttgatcttcataatctgttatcatctgtttagagtgaggtttgaagatagtactcctgaatgttcttctgcaagataccttttcctttttagaaaattgtatgcagattactttaatatggcttttgtgccattttcaagaactgacaaatagcaataatgatagttgaatgtaaatggtgtattttatattaagaatttctttaaaagagactgtattatatagataatcatgttactgagtgcttggaaattatttgtgcatgattttctttattttgccagaatttggatttaacaaaaaggaagatgattcatgaagggccattggtttggaaggtgaatagagataaaactattggtaggtctgatattgtcttttagttttggggagagtggcaaaagggaaggaataggaaagtttcctatgacaaagggaagaggagagaaccattctctcagcagtttgcagtgctacctcgtgttatttgtacatttgtagatctgcttgtgttatttcattatatgtaagatgtgttaaatattcatttaggaatgtagtggagaactgatttagtcctatttccatcattcttatagtctagtgagtctttgtatgctttgtaagctttctttagaccagtacatcttaaactgtctgtgatgaggaaccgtttttgttttttcagaaacaaggtctttctatgttgcccaggctggagcacagtggctagtcacagatgcagtcatggtgcactgctgcctcgaactcctgggcttaagggatcctcctgccttagcctccctagtagccgggactataggcgcacagcaccacacccagcttgttgttttttatttcctattggtcacagactgacacttcagtgaaataaaataaaaatgaattactgaaaatgaaattttaaaagataatatacaagtcaatttttaaaattttgtagctttaacagaaatagaattcctctgttgaatcattataaagttaatcaaacgcgtctccatttctgtacttaccatttttttctgcacttttatttctagatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacaggcaagtatgtccactgaaggatactaatttccagattcattgtgaagttgcataagatactcggtgctgtctcaataacacaagtggcatagagtcttgctatttttatattcttaagcaaattacatgaaatttactgcttagaaagagacctaagagtttataccccaaagttattagggtgtctcgattctgtgaacagttttctgcatttgaaaatttttatgctattactttggttctttatgttcaaatcattgatagatcccaatgaaaagcctttcatttagggtggtatgttttttgatttggtgagaaaaaaatcaaaaaccaaagagacggatgtagtgttgattaaaaatcaaatttgactggcaagttatattttaactctattaacaacggggtcccttttaaaacttgttagtttcatggtggcaaaataaatttgtgacctcttttctccactactcactgaatattattaactaacaacttagcaaaagtgcagttcaaaataaatgcaaaagagtaatagcatttaatctggtaatttggatttatttattttttttcttttgagacgagggtcccaccctgtcacccaggctggagtgcagtggtacaaccttggcacactgcaacctccacatcccaggctcaagcaattcttcaacctcagcctcctgagtagctgggactacaggcatgcaccaccatgacctggctaatttttttgttttatgtagaggcagggtttcgccatgctgcccaggctggtctcgaactcctgagctccaagcggtccacctgcctcggcctcctaaagtactgggattacaggtgtgagccaccgtgcccggccagtaatttggatttttgacatgcttttagcaaagtttctagtaaattattgtggaattagtgctaattcgtataatctttgttttattgaagtacaataaatatagtacaataaatacgttaatatggtaagttgcacaaattttaagtgtacatcttgatgaattttaaagtaaatatatgtaacctttatctagtttaaggggcagactatttcaagaccctaaaaacatccctcatggcctccccaggtcatagtattagagtaatcttgtattgttttttccagataacaaagctttattcgtcatttccatgtcagacaatggcgctcagatttatgaactggtggcacagacagtttctgaaaagactgtgtatgtatcagatatggctaccttgctatagctaatattttcattatcccaagcgtaatattccataaacttaactttgtttttataatgtatggaaaccaagcacttcctctgtactcttttagagacgttctactatgaacttgttcttttttaggttgatgccttttattttgattctattctgaaagtttatttcctaaagaaaaaattgtgcaaaatgtcaagtgaagtttttttaatgtgtccatagatttctcttaaggtatagttttggactctcgccttaatagtgtgttgccaaaataaagatattctctggcagagtgggttttgttgttgttgttgttgttgttgttgttgttgttgttggttgatttggtttttgtttagttttgctttctgagtatatttaaaggatatttcttttttcttttttgtattttggatttctttccaactttctgaagctggcaggacctaatctgtcggatggctgcatcagtgaaggagcaatccacaaagccaattccattaccacagtcaacacctggcgagtgagtgttcctttgcattgtagtaggacttattttatgttttgggttggaaaagactaggataattattatgttttgttgcgatgatgtttagatacctcaggaaggtaaaagtttttttttttttttttttctctacagaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagataggcgtatcacctgaggccaggagttagaggccaacctgaccaacatgacaaaaccctgtctctactaaaaaatacaaaaattagccgggcatggtggtaggtgcctgtaatcccagctacttgggaggctgaggcagggagaattgcttgaacccaggaggcggaggttacggtgagccgagatcgtgccattgcactccagcctgggcaacaagaccgaaacaccaaaaaaaaaaaagaaaaaaagaaaaaaaagaaaataaaataaaatgcaaagaaactttaatactgtttggtttatgcaggttccagcatcagagattcagtttaacaaactttgcctttgagccttctgtgtgtcagtataacactgttctaagtgatgtgtatttttcttaacagatgatctctgtagtttatggattgttttttttttttctgattcttccctgaatgcttcatgttaaaagttaaaagctttgtttagatatagtctaccttttctattccattggacagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaattctaagttttattcataacttattacagatacttactaagtatgacactcatgtgccatccctaaagtatgtggatttatcaaactccacttattcttctagttctattgtggagattatagtattctctacagtggcccatgccacaggcacacacacacatgccactctgttagctccccacccccctgcctggttcagaatcactgttaaaatgggaggatagcatatctctcagttgtattgaggtgggaaaaaggctgagaacaatttctttggctggggagaaccacttgaaatttttaaaccagcgtatgactaaaggtatgaaaaaagattaatctggctgaaagcggtggaaggatttgaatggaaagaggtatggaatggtgtacttactaaataagctattataatagtctggcctgagactaaaagagtttggactagaatgttatcagaaggaataagaagaaactgagaagtcatcaaatgcttaaaataattgacttctttgaatgtgaggtcaaaggaaagggaatatttagagataatttcattaatctagtcagaaataagagtcagaaaaggactaccactgcttcccccacctccttccattgtactttcttttttctttcttttgatttggtagaattataggctcagttttaaagcatgtcaagattaagataatgaatgacaaaacactaaaaagtgagtaactagcaggaagttagagttttaggagtgaaactttagagagaggttaggaagagatagagatgtgagcatcagagccatgagacttcctggcatctctcaggaagtgattgtagagcagaaggacagaggatgagagacctaagtggaacctgttgcctaaagaaacatgacagacattaagctagtgatgagagcagagaattggttatttaaaacctacaatattttttataccttctcctgaattaacagtcttaataatttctgatggttggaataacattgtcccaataactctatcattgtctgggtgacctcatagcatacacttggcccattcaaaattaaattggttcttattttcagtaaatgtatgtatctcataaaattagaggaaataatatgcatatagtgtctggatctggaaaaagcagaacttttttttagctttttctgtctagcttaacacagcctttcaacattcttaagaagtacctttagggtattattctagttatatagaagaaaaaatagaggcatgatattggttattgaggagttctaaatagtagtatctccctattcagaatgcttagatcttttcaagtttagtttaacgttaaatcttctctaaaagatggtgctttatttcatcttcaaaacaaaatggaaaatgattgtatgaagtaagatgattgtatgaaattaataattaacattttaatatgtcattaaaagatactttttaaagatagatcattggtaagtcagctaatttaattcttgcagcctgaggttatagttgtgaatatgttttttttccccctccttcctaaatcgtttagtgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggcaagtatctttcacacttaaactttgattttgattttgatcattgttaactgtcctgtattttgaaatggatgttgtattggtatccaggtgtgtgtgtgtgtgtgtgttcacacatgtgcaatatttattccttcatttgataaatactgaatctactctgtaccagacctcatcataggtgctgggagatatagcagtgaataaaacacagaaaaatcccatcttctcatgaagctaggggaaagaaggatggtaaataagtaaacaaataaatagacttcaggaagtattaggaagaaacataagtcagactgaggggacggagagtaatgaaggcaaacagggtgatcagggattaggacctccgatgaggtagcatttgagcagagacctcaatgaaatgagggaataaagccgggtgggtacctgggagcttactattccagcagagagcagagtggggcagaggctttgtgtcaaagagcaagctttttgtggtgatcgaacactggatgagggagacaatggcaggagatggggcaagagaggcgtttggcaggggaagtggtagcaagatcatttaggcactgtagtttccagctttaaacttttgaaatgaaattttttggaaattaccatgaaagtttgcagagtttagctttcatctgaagtgaggaaattctgatgtacctgaaactaaactcaggaattaatggcttttccctctcttaataacttttcaagttgaagttgtcagcacactatgctatttctgttttctaatggcagcactggtcttatcaaactattctgtctctatccataggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaaggtacctcatacttccacatccataggacttggttgtaagaaacatttagcagaggggaagaatagggtgatgaaaatgctgatgtcaataaacttgttcaggttctagatttctttgactattatccatgaataggcctgggtaaaaagttgagattggcattgtttatctttttctttctttctttttttttttttttttgagacggagtctcgctctgtcaaccaggctagagtgcagtggcgtgatctcagctcactgcaagctctgccttccaggttcacaccattctcctgcctcagcctcccaagcagctgggactacaggcacccgcccccacgcccagctaattttttgtatttttaatagagacggggtttcaccatgttagccaggatggtctcgatctcctgacctcgtgatccgcctgcctcggcctcccaaagtactgggattacaggcgtgagccaccgcgcccagtcggcattgtttatcttttgactatcacaagagcagaaaaagttgcagctctgtgaactgtgtgtttgtatgggtgtctaagtttaagaacctgaaatgcttcgggtagttggctggcctctgtcagacatgaacaagaagatgagataggtagggtttatgtagttatgaatctaggctgagaaatgctatgactttctgtagcctattatctgtgactcattaggtgacattggcagcttcccaaatcctatgacagatagaaattggcttcagtggctcctgtaatctaaaaacatggtcatgcatgggatttttgtagattggtaattgaagatgtcactattgcaaaactgacttgtgtggcaatttccaagagaaagacctatcttaaagttttccatcagaggcagggcacggtggctcacgcctgtaattccagcactttgggaggcaaggcaggcggatcacgaggtcaggagatcgagaccatccttgctaacacggtgaaaccccgtctctactaaaaataaaaaaaatcagccaggtgtggtggtgggcgcctgtagtcccagctactcaggaggctgaggcaggagaatggcatgaacctgggaggcggagcttgcagggagctgagatcacgccactgcactccaacctgggtgacagagcgagactctgtctcaaaaaaaaaaaaaaaagtttgccatcagaaaacacagcttccagagcccaaacattttcctcatgacatcatttacaccagagacttgaggggtagatttaagtatccttagcctttgagttaaagactggtctcccttagtttctcttttaccttcatataattgatttttccctcttcatgttacttattttatgtagtatcattctgtagctgatgagatatcgacaagcccattgaggacaggtcggttcttatatacagtcatgtgttgcttagcaatggggatatattctgagaaattcatcattaggcatttttatctttgtgtgaacttcacagagtgtacttacacaaacctagatagaatatatctttatttacatagattttttcatatggaaagccaaatctctcaacactattactgaatattagtcatttcccctacctgatcagcaatgccattattaagtgccacacaccaggtttctacatgtgctccataataatcttttttttttttttttttttttgagacagtcttgctctgtcacccaggctggagtgcagtggcgctatttcggctcactgcaacctctgcctcccaggttcaagcgattctcctgccttggcctcccaaggagctgggactacaggcaccaccaccatgcccagataaatttttttttttttttaaatggagtctcggtctgtcacccaggctggagtgcaatggtgcaatctcggctcaccgcaacctccgcctcccgggttcaagcgattctcctgcctcagcttcctgagtagctgggattacaggtgcccgccaccacacccagctaatttttttctatcttttaatttatttatgtatttatattttttgagacagagtcttgctctgtcgcccaggctggagtgcagtggcatgatctctcctcactgcaagctccacctcccaggttcacgccattctcctgcctcagcctccccagtagctgggactacaggcgcctgccaccatgcccggctaattttttttatttttagtagagacggggtttcaccatgttagcctggatggtctcgatctcctgacctcgtgatccgcctgcctcggcctcccaaagtgttgggattacaggcgtgagccaccgcgcccagtcccagctaatttttataattttagtagagacaggatttcaccatgttggccaggctggtctggaactcctgacctcaggtgatccacctgcctcggcctcccaaagtgctgggattacaggcgtgagccaccatgccccacccataataatcttaagggaccatcatcatgtatgcaggccgccatgtctttatgtgctgcatgactatagctcatgcacatgatgacgggaccatgtccagggtgactcctgggggtgggagaattgcatctatggttaccacctctactttctttttacatgggaaaatactaagttattccttcagtggagaaattggtaaaaggaatgaaatttacttttttcttcccactaatgaaatttttaatgatgaagttaatatttttgaaatttgggggcttgtacctgtaatgtaaaaagggcttcttttctgttttctgaagtttttgttttgttttgtttcattacgtttgaataaaaaacctatgggttttatttcacagaaggtggaggaaagttacaccattctttgccaaaggctggctggatcagccctcacagacaagcactcaggtatgtaaaagttatgagttccagactctagactaatcatcctacactgaatgaaatgacttatcatactttgaagtgaaaaccttctgagattccatttctcttctgtctttaaagaactgcctgtttctaaacatcagatatcaagcggaagctcatgcctgctgactctactcttctctaagaggaactgcagttgtcagttcccataccatcccctcttctctctcttttcaccttttcaaagcagaaggcagagcagtgggaagcctggtaaatcacagattcggtgtgaggcttactggtactgctgtgactccctagtgtggaggatttggccttattggatgttggtgcacttgcctctgctgacagtgtggctggtgtctcccctgactgcagatggatttgtgttccctgcagcagtttatactcatctgcttacatactgattcagaaacaaagattgaaccacgcccacagatgtcatgggtattctttgcaatgttagtatattctttttcttaatatcatttccatgtatctttattcttctcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 8 - RNA, 10326 nt, Homo sapiens
  source 1..10326: mol_type = other RNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 9 - RNA, 6891 nt, Homo sapiens
  source 1..6891: mol_type = other RNA
tcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaa

SEQ ID NO: 10 - RNA, 8753 nt, Homo sapiens
  source 1..8753: mol_type = other RNA
cttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaa

SEQ ID NO: 11 - RNA, 10269 nt, Homo sapiens
  source 1..10269: mol_type = other RNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 12 - RNA, 9623 nt, Homo sapiens
  source 1..9623: mol_type = other RNA
atctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 13 - RNA, 9501 nt, Homo sapiens
  source 1..9501: mol_type = other RNA
ggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgacttttactttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 14 - RNA, 3788 nt, Homo sapiens
  source 1..3788: mol_type = other RNA
aaaaaatcatctgacaaatgcctttccaaggatgtcgaatgtatatataaagaaaaagcttagggttgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcgttggacatatgtctcccatcatgacatctcctcattcacctggagcatctgggaatatggagagaatcactagtcctgtgctcatgggggaggaaaacagtgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagatgggcgtatcac

SEQ ID NO: 15 - RNA, 8283 nt, Homo sapiens
  source 1..8283: mol_type = other RNA
gcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagcctcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagagggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttagatggatcaacttggatctttagacctcatctataaattgaaattatatttttagtcataagccaagtacaatctaactcagaatgggattaaaaattttagaagcagaagctaatatataaatgaagtttgggattcggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaagg

SEQ ID NO: 16 - RNA, 10326 nt, Homo sapiens
  source 1..10326: mol_type = other RNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 17 - RNA, 6891 nt, Homo sapiens
  source 1..6891: mol_type = other RNA
tcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaa

SEQ ID NO: 18 - RNA, 8753 nt, Homo sapiens
  source 1..8753: mol_type = other RNA
cttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaa

SEQ ID NO: 19 - RNA, 10269 nt, Homo sapiens
  source 1..10269: mol_type = other RNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 20 - RNA, 9623 nt, Homo sapiens
  source 1..9623: mol_type = other RNA
atctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 21 - RNA, 9501 nt, Homo sapiens
  source 1..9501: mol_type = other RNA
ggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgacttttactttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 22 - RNA, 3788 nt, Homo sapiens
  source 1..3788: mol_type = other RNA
aaaaaatcatctgacaaatgcctttccaaggatgtcgaatgtatatataaagaaaaagcttagggttgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcgttggacatatgtctcccatcatgacatctcctcattcacctggagcatctgggaatatggagagaatcactagtcctgtgctcatgggggaggaaaacagtgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagatgggcgtatcac

SEQ ID NO: 23 - RNA, 8283 nt, Homo sapiens
  source 1..8283: mol_type = other RNA
gcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagcctcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagagggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttagatggatcaacttggatctttagacctcatctataaattgaaattatatttttagtcataagccaagtacaatctaactcagaatgggattaaaaattttagaagcagaagctaatatataaatgaagtttgggattcggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaagg

SEQ ID NO: 24 - RNA, 10326 nt, Homo sapiens
  source 1..10326: mol_type = other RNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 25 - RNA, 6891 nt, Homo sapiens
  source 1..6891: mol_type = other RNA
tcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaa

SEQ ID NO: 26 - RNA, 8753 nt, Homo sapiens
  source 1..8753: mol_type = other RNA
cttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaa

SEQ ID NO: 27 - RNA, 10269 nt, Homo sapiens
  source 1..10269: mol_type = other RNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 28 - RNA, 9623 nt, Homo sapiens
  source 1..9623: mol_type = other RNA
atctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 29 - RNA, 9501 nt, Homo sapiens
  source 1..9501: mol_type = other RNA
ggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgacttttactttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 30 - RNA, 8283 nt, Homo sapiens
  source 1..8283: mol_type = other RNA
gcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagcctcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagagggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttagatggatcaacttggatctttagacctcatctataaattgaaattatatttttagtcataagccaagtacaatctaactcagaatgggattaaaaattttagaagcagaagctaatatataaatgaagtttgggattcggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaagg

SEQ ID NO: 31 - RNA, 10326 nt, Homo sapiens
  source 1..10326: mol_type = other RNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 32 - RNA, 6891 nt, Homo sapiens
  source 1..6891: mol_type = other RNA
tcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaa

SEQ ID NO: 33 - RNA, 8753 nt, Homo sapiens
  source 1..8753: mol_type = other RNA
cttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaa

SEQ ID NO: 34 - RNA, 10269 nt, Homo sapiens
  source 1..10269: mol_type = other RNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 35 - RNA, 9623 nt, Homo sapiens
  source 1..9623: mol_type = other RNA
atctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 36 - RNA, 9501 nt, Homo sapiens
  source 1..9501: mol_type = other RNA
ggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgacttttactttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 37 - RNA, 3788 nt, Homo sapiens
  source 1..3788: mol_type = other RNA
aaaaaatcatctgacaaatgcctttccaaggatgtcgaatgtatatataaagaaaaagcttagggttgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcgttggacatatgtctcccatcatgacatctcctcattcacctggagcatctgggaatatggagagaatcactagtcctgtgctcatgggggaggaaaacagtgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagatgggcgtatcac

SEQ ID NO: 38 - RNA, 8283 nt, Homo sapiens
  source 1..8283: mol_type = other RNA
gcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagcctcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagagggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttagatggatcaacttggatctttagacctcatctataaattgaaattatatttttagtcataagccaagtacaatctaactcagaatgggattaaaaattttagaagcagaagctaatatataaatgaagtttgggattcggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaagg

SEQ ID NO: 39 - DNA, 10326 bp, Homo sapiens
  source 1..10326: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 40 - DNA, 6891 bp, Homo sapiens
  source 1..6891: mol_type = genomic DNA
tcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaa

SEQ ID NO: 41 - DNA, 8753 bp, Homo sapiens
  source 1..8753: mol_type = genomic DNA
cttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaa

SEQ ID NO: 42 - DNA, 10269 bp, Homo sapiens
  source 1..10269: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 43 - DNA, 9623 bp, Homo sapiens
  source 1..9623: mol_type = genomic DNA
atctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 44 - DNA, 9501 bp, Homo sapiens
  source 1..9501: mol_type = genomic DNA
ggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgacttttactttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 45 - DNA, 3788 bp, Homo sapiens
  source 1..3788: mol_type = genomic DNA
aaaaaatcatctgacaaatgcctttccaaggatgtcgaatgtatatataaagaaaaagcttagggttgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcgttggacatatgtctcccatcatgacatctcctcattcacctggagcatctgggaatatggagagaatcactagtcctgtgctcatgggggaggaaaacagtgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagatgggcgtatcac

SEQ ID NO: 46 - DNA, 8283 bp, Homo sapiens
  source 1..8283: mol_type = genomic DNA
gcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagcctcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagagggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttagatggatcaacttggatctttagacctcatctataaattgaaattatatttttagtcataagccaagtacaatctaactcagaatgggattaaaaattttagaagcagaagctaatatataaatgaagtttgggattcggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaagg

SEQ ID NO: 47 - DNA, 10326 bp, Homo sapiens
  source 1..10326: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 48 - DNA, 6891 bp, Homo sapiens
  source 1..6891: mol_type = genomic DNA
tcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaa

SEQ ID NO: 49 - DNA, 8753 bp, Homo sapiens
  source 1..8753: mol_type = genomic DNA
cttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaa

SEQ ID NO: 50 - DNA, 10269 bp, Homo sapiens
  source 1..10269: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 51 - DNA, 9623 bp, Homo sapiens
  source 1..9623: mol_type = genomic DNA
atctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 52 - DNA, 9501 bp, Homo sapiens
  source 1..9501: mol_type = genomic DNA
ggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgacttttactttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 53 - DNA, 3788 bp, Homo sapiens
  source 1..3788: mol_type = genomic DNA
aaaaaatcatctgacaaatgcctttccaaggatgtcgaatgtatatataaagaaaaagcttagggttgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcgttggacatatgtctcccatcatgacatctcctcattcacctggagcatctgggaatatggagagaatcactagtcctgtgctcatgggggaggaaaacagtgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagatgggcgtatcac

SEQ ID NO: 54 - DNA, 8283 bp, Homo sapiens
  source 1..8283: mol_type = genomic DNA
gcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattttgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagcctcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagagggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttagatggatcaacttggatctttagacctcatctataaattgaaattatatttttagtcataagccaagtacaatctaactcagaatgggattaaaaattttagaagcagaagctaatatataaatgaagtttgggattcggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaagg

SEQ ID NO: 55 - DNA, 10326 bp, Homo sapiens
  source 1..10326: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 56 - DNA, 6891 bp, Homo sapiens
  source 1..6891: mol_type = genomic DNA
tcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaa

SEQ ID NO: 57 - DNA, 8753 bp, Homo sapiens
  source 1..8753: mol_type = genomic DNA
cttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaa

SEQ ID NO: 58 - DNA, 10269 bp, Homo sapiens
  source 1..10269: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 59 - DNA, 9623 bp, Homo sapiens
  source 1..9623: mol_type = genomic DNA
atctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 60 - DNA, 9501 bp, Homo sapiens
  source 1..9501: mol_type = genomic DNA
ggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgacttttactttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 61 - DNA, 8283 bp, Homo sapiens
  source 1..8283: mol_type = genomic DNA
gcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctgtcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagcctcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagagggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttagatggatcaacttggatctttagacctcatctataaattgaaattatatttttagtcataagccaagtacaatctaactcagaatgggattaaaaattttagaagcagaagctaatatataaatgaagtttgggattcggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaagg

SEQ ID NO: 62 - DNA, 10326 bp, Homo sapiens
  source 1..10326: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 63 - DNA, 6891 bp, Homo sapiens
  source 1..6891: mol_type = genomic DNA
tcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaa

SEQ ID NO: 64 - DNA, 8753 bp, Homo sapiens
  source 1..8753: mol_type = genomic DNA
cttcttatcatccctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaa

SEQ ID NO: 65 - DNA, 10269 bp, Homo sapiens
  source 1..10269: mol_type = genomic DNA
agaacccggcgagccggccctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 66 - DNA, 9623 bp, Homo sapiens
  source 1..9623: mol_type = genomic DNA
atctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 67 - DNA, 9501 bp, Homo sapiens
  source 1..9501: mol_type = genomic DNA
ggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgacttttactttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 68 - DNA, 3788 bp, Homo sapiens
  source 1..3788: mol_type = genomic DNA
aaaaaatcatctgacaaatgcctttccaaggatgtcgaatgtatatataaagaaaaagcttagggttgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcgttggacatatgtctcccatcatgacatctcctcattcacctggagcatctgggaatatggagagaatcactagtcctgtgctcatgggggaggaaaacagtgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagatgggcgtatcac

SEQ ID NO: 69 - DNA, 8283 bp, Homo sapiens
  source 1..8283: mol_type = genomic DNA
gcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgattaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagcctcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagagggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttagatggatcaacttggatctttagacctcatctataaattgaaattatatttttagtcataagccaagtacaatctaactcagaatgggattaaaaattttagaagcagaagctaatatataaatgaagtttgggattcggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaagg

SEQ ID NO: 70 - protein, 1544 aa, Homo sapiens
MSGTQSTITDRFPLKKPIRHGSILNRESPTDKKQKVERIASHDFDPTDSSSKKTKSSSEESRSEIYGLVQRCVIIQKDDNGFGLTVSGDNPVFVQSVKEDGAAMRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 71 - protein, 1525 aa, Homo sapiens
MSGTQSTITDRFPLKKPIRHGSILNRESPTDKKQKVERIASHDFDPTGLVQRCVIIQKDDNGFGLTVSGDNPVFVQSVKEDGAAMRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 72 - protein, 1441 aa, Homo sapiens
MRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 73 - protein, 1078 aa, Homo sapiens [sequence omitted]

SEQ ID NO: 74 - protein, 1544 aa, Homo sapiens [sequence omitted]

SEQ ID NO: 75 - protein, 1525 aa, Homo sapiens [sequence omitted]

SEQ ID NO: 76 - protein, 1441 aa, Homo sapiens [sequence omitted]

SEQ ID NO: 77 - protein, 1078 aa, Homo sapiens
MRAGVQTGDRIIKVNGTLVTHSNHLEVVKLIKSGSYVALTVQGRPPGSPQIPLADSEVEPSVVGHMSPIMTSPHSPGASGNMERITSPVLMGEENSVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNFVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPGTLF

SEQ ID NO: 78 - protein, 1544 aa, Homo sapiens
MSGTQSTITDRFPLKKPIRHGSILNRESPTDKKQKVERIASHDFDPTDSSSKKTKSSSEESRSEIYGLVQRCVIIQKDDNGFGLTVSGDNPVFVQSVKEDGAAMRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKACHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 79 - protein, 1525 aa, Homo sapiens [sequence omitted]

SEQ ID NO: 80 - protein, 1441 aa, Homo sapiens
MRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKACHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 81 - protein, 1155 aa, Homo sapiens
MSGTQSTITDRFPLKKPIRHGSILNRESPTDKKQKVERIASHDFDPTDSSSKKTKSSSEESRSEIYGLVQRCVIIQKDDNGFGLTVSGDNPVFVQSVKEDGAAMRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDND

SEQ ID NO: 82 - protein, 1136 aa, Homo sapiens
MSGTQSTITDRFPLKKPIRHGSILNRESPTDKKQKVERIASHDFDPTGLVQRCVIIQKDDNGFGLTVSGDNPVFVQSVKEDGAAMRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDND

SEQ ID NO: 83 - protein, 1052 aa, Homo sapiens
MRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDND

SEQ ID NO: 84 - DNA, 20 bp, synthetic construct
  misc_feature 1..20: note = gRNA Recognition Sequence
  source 1..20: mol_type = other DNA
ggcgacgctgataatcttct

SEQ ID NO: 85 - DNA, 20 bp, synthetic construct
  misc_feature 1..20: note = gRNA Recognition Sequence
  source 1..20: mol_type = other DNA
gtactctgacaacttcaggc

SEQ ID NO: 86 - DNA, 20 bp, synthetic construct
  misc_feature 1..20: note = gRNA Recognition Sequence
  source 1..20: mol_type = other DNA
tactaagtacccacttctgt

SEQ ID NO: 87 - DNA, 20 bp, synthetic construct
  misc_feature 1..20: note = gRNA Recognition Sequence
  source 1..20: mol_type = other DNA
ttgggtactctgacaacttc

SEQ ID NO: 88 - DNA, 20 bp, synthetic construct
  misc_feature 1..20: note = gRNA Recognition Sequence
  source 1..20: mol_type = other DNA
acttcaggctggaggtatca

SEQ ID NO: 89 - DNA, 20 bp, synthetic construct
  misc_feature 1..20: note = gRNA Recognition Sequence
  source 1..20: mol_type = other DNA
acccaaatgttgaagagctc

SEQ ID NO: 90 - DNA, 20 bp, synthetic construct
  misc_feature 1..20: note = gRNA Recognition Sequence
  source 1..20: mol_type = other DNA
aaacccagccacacgagacc

SEQ ID NO: 91 - DNA, 20 bp, synthetic construct
  misc_feature 1..20: note = gRNA Recognition Sequence
  source 1..20: mol_type = other DNA
gcaggacctaatctgtcgga

SEQ ID NO: 92 - DNA, 20 bp, synthetic construct
  misc_feature 1..20: note = gRNA Recognition Sequence
  source 1..20: mol_type = other DNA
atgcagccatccgacagatt

SEQ ID NO: 93 - DNA, 20 bp, synthetic construct
  misc_feature 1..20: note = gRNA Recognition Sequence
  source 1..20: mol_type = other DNA
ccacagtcaacacctggcga

SEQ ID NO: 94 - DNA, 20 bp, synthetic construct
  misc_feature 1..20: note = gRNA Recognition Sequence
  source 1..20: mol_type = other DNA
tcatcattatctccttcgcc

SEQ ID NO: 95 - DNA, 20 bp, synthetic construct
  misc_feature 1..20: note = gRNA Recognition Sequence
  source 1..20: mol_type = other DNA
tcggatggctgcatcagtga

SEQ ID NO: 96 - DNA, 20 bp, synthetic construct
  misc_feature 1..20: note = gRNA Recognition Sequence
  source 1..20: mol_type = other DNA
ccttcgccaggtgttgactg

SEQ ID NO: 97 - DNA, 20 bp, synthetic construct
  misc_feature 1..20: note = gRNA Recognition Sequence
  source 1..20: mol_type = other DNA
tctaatcccaaatctctgtc

SEQ ID NO: 98 - DNA, 20 bp, synthetic construct
  misc_feature 1..20: note = gRNA Recognition Sequence
  source 1..20: mol_type = other DNA
ccattaccacagtcaacacc

SEQ ID NO: 99 - DNA, 20 bp, synthetic construct
  misc_feature 1..20: note = gRNA Recognition Sequence
  source 1..20: mol_type = other DNA
cagcatggcatttcagtcac

SEQ ID NO: 100 - DNA, 20 bp, synthetic construct
  misc_feature 1..20: note = gRNA Recognition Sequence
  source 1..20: mol_type = other DNA
tttgactgagaagagcgttc

SEQ ID NO: 101 - DNA, 20 bp, synthetic construct
  misc_feature 1..20: note = gRNA Recognition Sequence
  source 1..20: mol_type = other DNA
ttttgctccacgggattcag

SEQ ID NO: 102 - DNA, 20 bp, synthetic construct
  misc_feature 1..20: note = gRNA Recognition Sequence
  source 1..20: mol_type = other DNA
tccacgggattcagtgggac

SEQ ID NO: 103 - DNA, 20 bp, synthetic construct
  misc_feature 1..20: note = gRNA Recognition Sequence
  source 1..20: mol_type = other DNA
tttgctccacgggattcagt

SEQ ID NO: 104 - DNA, 20 bp, synthetic construct
  misc_feature 1..20: note = gRNA Recognition Sequence
  source 1..20: mol_type = other DNA
gccagtcccactgaatcccg

SEQ ID NO: 105 - DNA, 20 bp, synthetic construct
  misc_feature 1..20: note = gRNA Recognition Sequence
  source 1..20: mol_type = other DNA
aatattaaggcctatcattc

SEQ ID NO: 106 - DNA, 20 bp, synthetic construct
  misc_feature 1..20: note = gRNA Recognition Sequence
  source 1..20: mol_type = other DNA
aaagattcagttgaagtccg

SEQ ID NO: 107 - DNA, 20 bp, synthetic construct
  misc_feature 1..20: note = gRNA Recognition Sequence
  source 1..20: mol_type = other DNA
ttgcaacttgttacagtcca

SEQ ID NO: 108 - DNA, 20 bp, synthetic construct
  misc_feature 1..20: note = gRNA Recognition Sequence
  source 1..20: mol_type = other DNA
ggacatatgccctttagaac

SEQ ID NO: 109 - DNA, 20 bp, synthetic construct
  misc_feature 1..20: note = gRNA Recognition Sequence
  source 1..20: mol_type = other DNA
ttcagtgggactggcacccc

SEQ ID NO: 110 - DNA, 20 bp, synthetic construct
  misc_feature 1..20: note = gRNA Recognition Sequence
  source 1..20: mol_type = other DNA
aactgaatcttttgctccac

What is claimed is:

1. A method of treating a human subject having glaucoma or elevated intraocular pressure (IOP), the method comprising administering a Rho Guanine Nucleotide Exchange Factor 12 (ARHGEF12) inhibitor and a therapeutic agent that treats or inhibits glaucoma or elevated IOP to the human subject, wherein the human subject is heterozygous or homozygous for ARHGEF12 Tyr1306Cys, Tyr1287Cys, Tyr1203Cys, Glu1156STOP, Glu1137STOP, Glu1053STOP, Tyr973Phe, Tyr954Phe, or Tyr870Phe polypeptide, and wherein the ARHGEF12 inhibitor is a small interfering RNA (siRNA) that hybridizes to an ARHGEF12 mRNA.

2. The method according to claim 1, wherein the glaucoma is primary open-angle glaucoma (POAG).

3. The method according to claim 1, wherein the therapeutic agent that treats or inhibits glaucoma or elevated IOP comprises a prostaglandin, a beta blocker, an alpha-adrenergic agonist, a carbonic anhydrase inhibitor, a rho kinase inhibitor, or a miotic or cholinergic agent.

4. The method according to claim 3, wherein:

the prostaglandin is latanopros, travoprost, tafluprost, bimatoprost, or latanoprostene bunod;

the beta blocker is timolol or betaxolol;

the alpha-adrenergic agonist is apraclonidine or brimonidine;

the carbonic anhydrase inhibitor is dorzolamide or brinzolamide;

the rho kinase inhibitor is netarsudil; and the miotic or cholinergic agent is pilocarpine.

5. A method of treating a human subject with a therapeutic agent that treats or inhibits glaucoma or elevated intraocular pressure (IOP), wherein the human subject is suffering from glaucoma or elevated IOP, the method comprising the steps of:

determining that the human subject has a Rho Guanine Nucleotide Exchange Factor 12 (ARHGEF12) predicted loss-of-function variant nucleic acid molecule encoding a human ARHGEF12 Tyr1306Cys, Tyr1287Cys, Tyr1203Cys, Glu1156STOP, Glu1137STOP, or Glu1053STOP polypeptide or an ARHGEF12 predicted gain-of-function variant nucleic acid molecule encoding a human ARHGEF12 Tyr973Phe, Tyr954Phe, or Tyr870Phe polypeptide by:

obtaining or having obtained a biological sample from the human subject; and performing or having performed a genotyping assay on the biological sample to determine that the human subject has a genotype comprising the ARHGEF12 predicted loss-of-function variant nucleic acid molecule or ARHGEF12 predicted gain-of-function variant nucleic acid molecule; and administering or continuing to administer to the human subject the therapeutic agent that treats or inhibits glaucoma or elevated IOP in an amount that is the same as or lower than a standard dosage amount, and administering to the human subject an ARHGEF12 inhibitor when the subject is heterozygous or homozygous for the ARHGEF12 predicted loss-of-function variant;

administering or continuing to administer to the human subject the therapeutic agent that treats or inhibits glaucoma or elevated IOP in a dosage amount that is the same as or greater than a standard dosage amount, and administering to the human subject an ARHGEF12 inhibitor when the human subject is heterozygous or homozygous for the ARHGEF12 predicted gain-of-function variant;

wherein the presence of a genotype having the ARHGEF12 predicted loss-of-function variant nucleic acid molecule encoding the human ARHGEF12 polypeptide indicates the human subject has a reduced risk of developing glaucoma or developing elevated IOP;

wherein the presence of a genotype having the ARHGEF12 predicted gain-of-function variant nucleic acid molecule encoding the human ARHGEF12 polypeptide indicates the human subject has an increased risk of developing glaucoma or developing elevated IOP; and wherein the ARHGEF12 inhibitor is a small interfering RNA (siRNA) that hybridizes to an ARHGEF12 mRNA.

6. The method according to claim 5, wherein:

the ARHGEF12 predicted gain-of-function variant nucleic acid molecule is:

a genomic nucleic acid molecule having a nucleotide sequence comprising a thymine at a position corresponding to position 132,939 according to SEQ ID NO:2, an mRNA molecule having a nucleotide sequence comprising a uracil at a position corresponding to: position 3,749 according to SEQ ID NO: 16, position 3,191 according to SEQ ID NO: 17, position 3,079 according to SEQ ID NO:18, position 3,692 according to SEQ ID NO: 19, position 3,046 according to SEQ ID NO:20, position 2,925 according to SEQ ID NO:21, position 3,054 according to SEQ ID NO:22, or position 2,615 according to SEQ ID NO:23; or a cDNA molecule produced from an mRNA molecule, wherein the cDNA molecule has a nucleotide sequence comprising a thymine at a position corresponding to: position 3,749 according to SEQ ID NO:47, position 3,191 according to SEQ ID NO:48, position 3,079 according to SEQ ID NO:49, position 3,692 according to SEQ ID NO:50, position 3,046 according to SEQ ID NO:51, position 2,925 according to SEQ ID NO:52, position 3,054 according to SEQ ID NO:53, or position 2,615 according to SEQ ID NO:54; and the ARHGEF12 predicted loss-of-function variant nucleic acid molecule is:

a genomic nucleic acid molecule having a nucleotide sequence comprising: a guanine at a position corresponding to position 143,698 according to SEQ ID NO:3, a thymine at a position corresponding to position 141,048 according to SEQ ID NO:4, an adenine at a position corresponding to position 73,039 according to SEQ ID NO:5, a cytosine at a position corresponding to position 121,307 according to SEQ ID NO:6, or a cytosine at a position corresponding to position 141, 978 according to SEQ ID NO:7;

an mRNA molecule having a nucleotide sequence comprising: a guanine at a position corresponding to position 4,748 according to SEQ ID NO:24, a guanine at a position corresponding to position 4,190 according to SEQ ID NO:25, a guanine at a position corresponding to position 4,078 according to SEQ ID NO:26, a guanine at a position corresponding to position 4,691 according to SEQ ID NO:27, a guanine at a position corresponding to position 4,045 according to SEQ ID NO:28, a guanine at a position corresponding to position 3,924 according to SEQ ID NO:29, a guanine at a position corresponding to position 3,614 according to SEQ ID NO:30, a uracil at a position corresponding to position 4,297 according to SEQ ID NO:31, a uracil at a position corresponding to position 3,739 according to SEQ ID NO:32, a uracil at a position corresponding to position 3,627 according to SEQ ID NO:33, a uracil at a position corresponding to position 4,240 according to SEQ ID NO:34, a uracil at a position corresponding to position 3,594 according to SEQ ID NO: 35, a uracil at a position corresponding to position 3,473 according to SEQ ID NO:36, a uracil at a position corresponding to position 3,602 according to SEQ ID NO:37, or a uracil at a position corresponding to position 3,163 according to SEQ ID NO:38; or a cDNA molecule produced from an mRNA molecule, wherein the cDNA molecule has a nucleotide sequence comprising: a guanine at a position corresponding to position 4,748 according to SEQ ID NO:55, a guanine at a position corresponding to position 4,190 according to SEQ ID NO:56, a guanine at a position corresponding to position 4,078 according to SEQ ID NO: 57, a guanine at a position corresponding to position 4,691 according to SEQ ID NO:58, a guanine at a position corresponding to position 4,045 according to SEQ ID NO:59, a guanine at a position corresponding to position 3,924 according to SEQ ID NO:60, a guanine at a position corresponding to position 3,614 according to SEQ ID NO:61, a thymine at a position corresponding to position 4,297 according to SEQ ID NO:62, a thymine at a position corresponding to position 3,379 according to SEQ ID NO:63, a thymine at a position corresponding to position 3,627 according to SEQ ID NO:64, a thymine at a position corresponding to position 4,240 according to SEQ ID NO:65, a thymine at a position corresponding to position 3,594 according to SEQ ID NO:66, a thymine at a position corresponding to position 3,473 according to SEQ ID NO:67, a thymine at a position corresponding to position 3,602 according to SEQ ID NO:68, or a thymine at a position corresponding to position 3,163 according to SEQ ID NO:69.

7. The method according to claim 5, wherein the therapeutic agent that treats or inhibits glaucoma or elevated IOP comprises a prostaglandin, a beta blocker, an alpha-adrenergic agonist, a carbonic anhydrase inhibitor, a rho kinase inhibitor, or a miotic or cholinergic agent.

8. The method according to claim 7, wherein:

the prostaglandin is latanopros, travoprost, tafluprost, bimatoprost, or latanoprostene bunod;

the beta blocker is timolol or betaxolol;

the alpha-adrenergic agonist is apraclonidine or brimonidine;

the carbonic anhydrase inhibitor is dorzolamide or brin-
   zolamide;
the rho kinase inhibitor is netarsudil; and
the miotic or cholinergic agent is pilocarpine.

* * * * *